United States Patent 10,619,170 (CRISPR-CAS SYSTEM FOR A YEAST HOST CELL) - sequence listing, part 10

SEQ ID NO: 6 - DNA, 10729437 bp, Kluyveromyces lactis NRRL Y-1140 (residues 6,437,665-8,583,552 of 10,729,437)
  misc_feature (5631879)..(5631879): n is a, c, g, or t
  misc_feature (5631991)..(5631991): n is a, c, g, or t
  misc_feature (5631993)..(5631993): n is a, c, g, or t
  misc_feature (5632001)..(5632006): n is a, c, g, or t
  misc_feature (5632008)..(5632012): n is a, c, g, or t
  misc_feature (5632015)..(5632015): n is a, c, g, or t
  misc_feature (5632018)..(5632025): n is a, c, g, or t
  misc_feature (5632030)..(5632030): n is a, c, g, or t
  misc_feature (5632036)..(5632036): n is a, c, g, or t
  misc_feature (5632038)..(5632041): n is a, c, g, or t
  misc_feature (5632058)..(5632059): n is a, c, g, or t
  misc_feature (5632089)..(5632089): n is a, c, g, or t
  misc_feature (5632091)..(5632098): n is a, c, g, or t
  misc_feature (5632110)..(5632110): n is a, c, g, or t
  misc_feature (5632114)..(5632114): n is a, c, g, or t
  misc_feature (5632136)..(5632136): n is a, c, g, or t
  misc_feature (5632140)..(5632140): n is a, c, g, or t
cccttccacatttggccaacaaggaacgcgtttaatcaagcccatgaagtaatactggtggattggcctcgacagatgctttactacattgaataccgtaatattatttgatgcatcttatcactcattctgaagttatcttgaaataatttaccgtatatagttttattacccggatatatgtacataggaacaggagagttaagtactgagtgaacgaaaacttgatggataattcagtcacgtagtagtcctttcaattgtctttcctgtttgatcgataaatcttcaacatcagctagtccttcgcgtgcaagtattttccggcccttccaattaacctcttctacttgatgtgttctctcatctatatcgaaatcgtcatgtaataaagtatgtacatctaactcatcaatcttagataaaagtttgttaagatcgttgatgagcttagatcccattattaccagtgatctcggtgacctctcattggatgttattttcactatatttccaacaaattcatccttgaattcttggacagataagtattcatcattttcaagcctggagctaatgtaaggtatgaccttgaaatttgaagatgattcgaggtctgcaaaagatttaaaagataaagtctttgtgagattgttccacacaacatccttcaatatataccttatcggatggaacgcaatgtcgtttatgatcctttggtttcttaccctttcaacattacattcttgtttagccaccaaagatgatgcaagaccttccaatgaattgaggtctctcaaaagaacttctgagaatacgattctgtcatttagctcttcggtatctagagtattcaaagaagatgggctgaactttcttaccaaaggagcgcctcttttgagttctcttttcattgtccagtacttgcatatatccaacgaaatttgctcggaatttggaacatgaaatctgtttaaaactctcattgtaatatctgcgaaggcttgaggtgcaattaaagttcccctactggttttccatttattcttaatggttttcttggcagattgcttgttttcttccacggcactgtcttgtagcaccttgtgatgattaatgtgattaaaataatccctagttttacgaattccgtcttcacagctactccagccgttaggagaatgtttgtgacaaaaactttccaggaaagcacctgtggaaaagttttttgaggcagcctcttgaactgtacatccattgaagttcatgtataatccagctcttttagcgcacgtagtgtgatacgctgcaaaacagttcttattcgagcattggatgcaagcaccgacctcttgtttgcaaatataacatgtgagcttccatcgacttttcgggatattctctattcctccaatcggctccatatagtgtagatttccgaaataaagctctggtatccaaattccacataacacatggccccacgatccgttatccgtttgtttgaaagctccagtggtactgggacaaaagagacactcgagctttctatttttggatatcatgcatcttcggcaaagccactgaccttctggaatgaaaactacaccatagcattcctgatgtacggcgatatcgcaaccatcgcaaaatactatcgcattcgaattatcacattctatgcctccacatactgcacacggttgatccattgggtatccagtaccgtcgtctgatccgtataactcatgatgcttccaggcagcatgagattcatgcgtattattagtagcactaggtgatactcttggtggaattttcttctctaaatggaaagcttcgttctctaatatcgtaataactatttcgaaaacttcgtgtgataacttatgcttagaatttgtcagtgccgtatttaagtgccgaaggaataagtcatcttgctcatccatatcatactctaccttaaaattaacctggtatggcgaaacatcagcaaaaaactcattgctatgcttcatcaatagatcagtcttcttacagtatgacttttgatctaatccgcaagtacgatctgcatgagatctgtatccgtattttaccaactgtttattaaccttgccatgaggatttagctgtgatatccgaatcttacagcgcttgaactctgcgttcttgatttgaggtcctagcatttcgattgttatgctatcgtttacgatcaattgtttccatgacttcaaatgttctcgcaaattatcgtcaggatacacttcttcttcatcgtggcgatgacgatcattcaactcatcatgattatttttcccaaaaaggacaaggtcatttacgtctaaatccggatagaaatgcttaaaactaacttcttctcgaagcctaacgccgtcctcttgagtttgcattagtttatcccaactatattacagcctatcgtatccaaaatgagcttcttcggtgaaaagaggcatgtcatcacatctaattggatcgttttcaacatataggccgattcatttatcttttttctttgttatggttttcggagtatatatcacgtgatatgattgaatgttaatttgacttaagaactgactctgcaagcgtccgtagatatgatcgacactcattgaacaatattagggttagcatctttgaaaagttgatcaaggcgtctagttatccttttatattactgctttttctttcatttgtaacggttttatgacattttgtgattaaaagtgatgtgccaagcaacaattaataagaagcatgaatttgcatattataaaaacacattatcgttacatagcgcattgtagaactaaggaacatatatatatatatatatatatatatatgtatattaactactttaagtggtatacatttgtatattcttgtaattagattcgaaaaaacccaaggaagatcatcccctactcttcgaaatcaagtaataaatcaacaggattttcggcacgtccgctgaacattaatttgctgttgtcttcgttctccattaatgtaccagacaaaaattgttgaagatcatcatgtatcgcgtttgctcccgcgtttgtctccttgacaagcatcggatatgttctactgtcaataatcctttctggatattgctcatcatcgttaatatattcattgttgatgtgagcttgttgttgttgttgttgttgttgttgttgttgttgttgttgttgttgttgttgttgttgttgttggtgtcgctgctgttggtattgttctgaggagatatgatgagtaatgggggattcagatttggaaatatgttggtaattttgagaagttttcgggtatgctcctgattgcaacagagaagaatttgtgagatccgacttttttctttcgagttcagcgatcttcttccttagttcttccttttttgcatcttgaatctctaaaacttgctttaagcaatccatatattcaattgttcttttcaatatagttcctttatttggttttaccttctttccaaaatcatcgaaatgtaacaatgttggtggaaccaatgtccccaactcctttattttagctttgatcagctctcttctacgcctttcgacggcattatgaaattctcttctcctacgtattttctcatcttgagtcaaagccgatgagttcatgtctttaggcgtggaagtcaaactgctacttgttggaaactgttgcgaacccctgttacttctcaatgacgatgagagttgcgaagcaccacgataactggcagaaggagaccttaaacttgaagacagttggttgtaagagtgggaatcaaacgaattcattggttgtggctggtacgatgaaactggtgtcatcaggtcactatggatactggaccccagagatgatacgaaatcatctgtaaagttgctaaccaagtcatctgtggcttgggagccttgcaaatgttcgcgaaacattggctcatcgaaaaggttcttggtggtctcgtccaaattaatatgatcaaaatcttgcttttggttccggtctgactctcctctacttgctggtgataggtattcgtccataaatgatgtagcaacagttccagtctcaatttgttggccagttatactttgttgtcttgactgcggcaaatgtatgttattatggacattggcattcgtaaaactggactgcgaatccggtagctcattaatgacatatttggatgtatgagccgtatggttcgtggatgcagatgtaccaagcccgggctccaaacttagttcaccatgtgaccccggaatattcataggaaccggagtgttggaactcgacagacgcatgccaaatgaacttccaacgtgtgcattatggttctgctgcaagaactgatccaaaaggtcgtcgttttcaaaatccatagtttcccctagttcttcttgttttgttcactggtgattcaaagatatcataaaacgggacagtcttcaacccgcactcttagacacacacaaattgattctacaacagaatattcaaatccagttctgggacacaataactctcgctgtttacacgccgatagtcatgcgataatttcattactgatgtaagaatatatagagaaagactaaacttcaactttgtttctttcatttaattgaaaattcccaagaaatttcaaaataattgaacatttgaacttcgatactatacagatcgattatgaataagagctgacgcgaaaggatctttgatttaagggtcattttagtaatttttgagggtctgcaagcggttagttccatactttgagtcttaccttccaataaagacgtccactaaagtagaatttgcaagtgtgcttctctcaatagttaagcatttataggggagaataagcatgtcagagaacaatccggaagttaacaatctaagagactcattgaatagatggaatgaatcacgaaatgcccattcccagggattcaatgaaggggcgaagacgatattcgcaagttgggcagactcgataaatgaaagagcccaagatgtgtatcagagactaccgttaacgcaacaagaccttacggcaaatccagagccagaatggttttcgttaagtaggactgaaagactttctctattcgtttgtttcatattgggtgctgtagcgtgcttcaccatttgtgtgtttttgttccctgtgcttgctgtacaaccaagaaagttcggtctactttggtcgatgggatctttgttgttcatctttgcatttggtgtattgcaaggacctgttgcatacatgagacacttaacatcaagggagcgtttaccattcacagtatttttctttgtctcttgctttttgaccatttactttgcagcatttaccaagagtacgcttttgacgattccttgtgcaattctagagttgatcgctgtcatttactacgcaatatcctatttcccctttggtggcacgggacttagaatgatcagttctatcggattgaatcaagcaaggggagttctccgtatctgaaatggttttttgcgagaggcgtaaatcagaacaacttgaaatattattattatgtacataaatatttgtgtaatattacatgagaggtgtaatttcttcataagtgggtggttcatcatcggatagtatggcttctgcatcttcactgtcactatctaagctttcctctagggaactctctgctttcattccttgcttcataaaagattccttgaacgtgactgtcggtccaggatttggtgatcttgctgtagttagtccagattgacccatcatctcatcaatattactatagcgtctagcgactgaagatgcagattgtagatcatctacgttctgcgtagaagcccgagaaagcatcaattgttgaatagataaatcatccggatcgtaggttgctcttaattgcggtgtgccgataggcgatacacggggcgaattcggaactgatatggcttcttcaaaacttggtaaaggttcatggaaacttatggttgtgtccttatcagggtgtgacattgtggccattgcgtaagtgggtaattcaagattatccgatgtgcaaagttcggaaacaacgtgaacaggagtgtcgattagaacttcaaagtgtctttgtttggttggatctgttgcatcaggtttactgatcctcaacattatctcaagtttgtgctttacattgatatggctaaagttgacactgcttgcatacaagccacgtttaggttcatttagacgggtatgattgacaatgggtaaattagagttggttctgaatttggtggtaggtttcggtaaatctaaattgttactgatcgatgaattctttctgctttttctacccgataagaaatcaattacaccagatgttgtgctaccgcgacgagacgtggagttggattttatgttctctagttgggtaaattcatcaataccataaggtggaacactccgtgctgactttttgttaaggagtttatatttggggaatttaagcttagtgtctattgtcaatgcttctaccatttcaacattggagttcgtgttctcatctctgactgtagaatagcaaagtaagttatcagatttacaattttcaacaatttcctctttcatggctctgccacctttatctcttgttcttatttccaacaatggtagtatacgctccggctttcgcctagaagagaactccggataatatggactgtaaggatcattcgcaactaattcaacttgatcaaactcatactgtaagtttttggaaacatatgtaattttttcaacaacacatatccttatccttttaacggatagatgtttcactagtggaaccaattttagtttcaaaggaatctcaacgtctaatgggacatatttctgtccgaatgatatttcgtacgaaagcgaatcagtccatattctgttaatatagatgggtttatcagcagtagaaatggatctcagcggaggagttctaacaagatttagtgccatatggctatataccatcttttgataatctgtcttagagattccatgataggaaggtaagtgtaagtggtttttcattttcttgaaaagcttaccacctccaaacttgaaatgacttgtagtaccatcaccagcagatgaaggaggatttgagtcatcgttagaatttgattggaatgccagagtgctgccggttccattatttgatagcccgctatcattatcgttactttttgtggaatcgttattagcactatcagtattatccgagttaatgactttggcagcacacctaaaatgataatttactctagcagatggtagacagatggtctcaggaatattattagcaaatacaacggggacaataaaaatataatcacccggctgaaacgtgcacgagttggtatcagaagcttcgtttatatctttgaggaaattatctttggtcttttgcttcttgagataaggtctgtcgccaaaatcctgaatgtttttaaaattctttcttctgcataaattttgtgtattttcaattattaccaactcttgatcagctgcagaaaacccaacatataggttgtaattatcggtattaaattcccaatccaaatgtccaccagtgtagtattcttctgtttccattttatcaggaggaagaccattactccagtatactcttaccctcgagtataattcggcttttacacttgaaagttccatttgtttcttgagagacattataacagcaatgttgtatggtatattttcgctatcagcggcaggtgagtcatcatccatggctgtatagctatctgttggttcaatgttggttgtgttaccattaccagtctcttcagttagcgatgattgcaccgggttagaagaggcaaattctgaatttcctgtcgccaaggattcgttttccctattcgcaaaaattgtagaatggcttcctgtaggaacaacgtctgatcttgagaactcagaaggatccctggtagctaaacgttctaacgcatcaccaaatgcaccatcatcatcatcatcattaagtctgctcaaatgatttaagtattcatcgtcagttggcgagatagtaggtaaaaatatgttatcaccggaagtggcaacgtggaaggtaacaccattcttcgaagaaagaagtcttggtcttaataatccacggtcagccaagtaatttagcaaacacgttttggcagtttttttcctgttcacgacggtgttgctgatctgcgaaccagtcgcactgaaagcggtcgatacccttgtaatcctcctgcccaaacaattctcctcaaagtcatcatcatcaccttcatcatctccatcgttttcattgtctggaccgtcatattcatcatcatcttcatcatcgcttaccacagagaaaggtccaccacgttcgtcatcattagacattctacgattaggctgactctgaaatctgctcggttgtaaagatgatgtgtagatgtcattgcctaggtctccatcagaatcgttgcctccaaggctataatccaacagactgctatctccttgatcctcgtcaatttcgttatcagttccttcttccgaagacatcgctaattcgttctgtggggctccgtaatcttgatatccatagatagaatacggcgttccaaaggccatcatcggactgaatcctgcaggcatagcagaagtgccatatgcgccactgggccgtctggaagatgccctacgagcgctattagagcttggtacacttgcggaacgtccattactgtttgaccttgaaagggtagaaccactactttttgacccgctagctcctaagatggatgcaaatgcttgcttgattgacgaagatcttttcctattcccatccttctgctttccagaggacgaccccagatgtgaactgaaaaatgacattatcttccaaccgtcgtggacctgtaaaatctcagcttatctctcaaaagggtttggttacttaccttggatgcaaaaagaaccaaatgatcaataaataaataactttaaaagtgaccaaagtgtgaagttcttgtttaggaaaaaccacaatactatatgtattcgctaacccactaagctgaatagattagactttgctctccctgctgaaacatcggattatatttatgttaatcatcagcctacttagttggtatgaactatttacatttcagatttgaagggttctttttcattaaaaacttccttgggcccagaaatcaggtttgggggccataaataatttccatgatttcgaaatctggaaaggacagttctataaacaagaatagctataaatacatgtaacgtatactgggcttgacaactgagaacagcgtacacggtatctgtaacttttgcaattaacgctgggagtgtgcgtgcgtgtggtgttttcaactataagttgtatataggtgcgcaaagagctttagcaattttttgtttgttgggaaacataagtagaaacaatgggttcattgaggactttcattaaggaagtcagggccgcgaaaacgttggctgaagaaaggtcaatcgttaccaaggaatcagcaaggatcaggaccaagttgaaggatgatcatatttcactggaaaggagaaggaagtacattaacaagctgttatatttgtatatcttgggagaaaagacacattttgcccaggtagagtgtataaacttaattgcttctgaagacttcgccgataagagagttggatatcttgctgcagttttgttattggatgagaatcaggaattgttgactcttttgaccaatcttttgaataacgatttgaatcatccatcgagatatgtggtttcgttagcaatcaacgcattgggcgctttgacttctccagagttggctcgtgatttgtataccgatatcaaaaatattctagagcattccagggacagttttctgatcaaaaaggcgttggcatgctctggaaaacttattgcgagggatccatcccttttggaaattttcgctccttacgctaacaagatgctttcgagtaaagaatctactagccatggtgttctaattggtaccaacaaattgatccaggcaatcatcatcaataccaaatcgtacgaatttgataatctaccagagatcattgataaactatcctccttgatacctgatctcttaggaaaactacaccatttgaatttaggatcgtccaacccagaatataacgttggcggttgtctcgatccatttttacaagtcgaactcatgactacattacgtttgttcttgcagtacttccctgagcaaactaagccttacaagaataactacttggatacattgacccgagttgcaacttacactccaactacttcgaatagttgtacttcagtcttatacgaggcagtgcgcactattttttcattccaagcagagcgctccttgagagtactaggtgtcaacgtgttgggtaatctagttgcagacaaggattacaacacaaaatatgtttcattaaacgcattgttagatgttgtttcggtagagccacaggcggtccaaaggcatagaaagtttatctcacgttgtatctttgattctgatatttcaatcaaaaagagggctcttgagatgacgttcgcaattttaaaccaaacaaatatgagggaattgatcgcagagattcttacgttcttagaaaaagcaggagaaaacgataaaggactaatattgtactgtgtagatcaacttataatggttttcgatcttcaagatgaaatagatgattcctggaaactggatgtcatagttaaaatattgaaatttgttggccaatatatttcagttgagaagactactgatgcattaattatgattaacaataattcgaacctggaacataagaagcaagtggtttctaacattatcaacgtagcattggataatgactctagccaagtctcagacgaaaatttagcatggagagttgtctcgatttggtgcatcggtgaatacgctgatctgattttaggtaatggcagatgcacagaaacaaatttaacaggttacttatatgaatccgatagcttgtactgtgataaccctatggtaacaagctatgttttgctggctgctttgaagctatctgtaaagattgatacaaaagtgctatccaatagattgaggcagttaattaaaggccacacggaaaacaccaacgtcatgattcaaacaaaggctgtccagtatggaatattattcaatgagtctacaagtgttaaagctgcgttacttgaaccaatgcccattttccataaaaaggtctcagagactgctgcattaagaaccttctctcagaaagtacctgcaccagctattaagaaagtgaaaaagaaggaaaatgatcttcttctagatttactaggagatctctctactccagaaactactgcgcctacaaaaccttctaatgatctattatctaacttgagcaatactccagcaccccaatcatcaaatcaaaatgggtcaactttatcatcatccttccaacaacgcatagaaataccaccaaactctatcaatatccactcatctgatattgttgaagtttatggtaaagtagaatcgtcaatccccggttgtactgaaatagacctattcttgaaagctaaaacgaatattaataccttacagatcctaatcgctgttcctaaatcacagaaggcagaattcggatctctgtcaagccacaaggtagctacaggtgaagtagctaagcagggtcttaaaattctaggatctgggaaaatcaagctaagggtcaaattgaatatcaactccaccgaggatcaattcgattataaatttgaaaacatcccccattaacgagcgttaaagatgccttaaagtaatattgtgtaaactataaaacgatataacaatcacatcatgtagataagggatctatgtcgataaacaccggtacgagttcacatttccgcaatcaaataagcgaactcaaaagaaaattggaccagagggtgatttttcaactaagaagaatttaacgggagtatccagaagccttagcgttgttggcagcagcttcgactttctgggccagttctcccgatttcccttccacgataggtaggtatttgtcagagaatggtgaaatcaacctcgtgtaaacaagttgggcaccgccgaatgatggaatggcaatgtacagtaagaaaacagtcttaaagaaccagtagaatggaacccagtacaaaatagccttggaccagaactcgatcacagacaaaaacgaaaaaacaatccaataagttaacaattgtgtgtcatccgttgatgtggcagtcttcaatgctttcaaagaatagtatgttggaatacagaatccaacaaagttggataaaatctcaccaattccaccaacattgataaaaattaagagaaagtaaacagcaacaagaccaacgataacatatgatcttggcaattttgtttgagcttcaatacgagacaaaatttgattaccagcgaatttctaagttagaattggttagtatattaagttttaaagtagtattattttctctgttagttacgagaagcatccgaaagataataaaaatcctagtaaacatacagtgtccaaacccttcaaggaatcttgaaataatttcagatagtctgccattgttgtttgattgtagatttgttggattgatagagtgcagacttaaggtaaatcaaaaaaatttgaaggaggaggaattatcgctcactggcaagttagatgtatccctttaaatttcattctttagtttatatttttttttcacttttcagaattcgttgcgttttaagaaacagccagacctaatggaatgttctatccgagccacagaaaacgaaaaaaaaaaagaggaacactaactttagcaagtggaaccaatatgagcaaatcaccaccggtttcaacaagtcgctgctttagctcagttgggagagcgtatgactgaagttcataaggtcctgtgttcgatccacagaagcagcatattttttctaatcccgtacgccttctttttttttggtttttttttcgccgctgaagtttcgaacgttcatattggaagctaatactatttaaaagtgtcagattgagtatatgaaggaatacactaaggaatgccaaaaaaaaaatgaaaacatttcattatgaataaaaacttttagggacagcatttgaattagctgaccgactaatcaaataactatcaaactaaaaatgtcccgtatatgagacttatgtgcatgtcttatgggaataatgcaaattctttaattgtcgctcccttttcatcatcgtcatcatcataagtgtcatgaacagttagaactatgaatcttccctttctccaatcagtttgattgccacgaaaatcaatatcaacattttcgggattcatttcagccacttttgaataatcaatatcgaaatcggtctcatttccaggcaataatacaatttgggactcattatatactcgccatgggtatggttctgatggtgttaccttatagtgatccaaaatctttacaaatttagttttcatatctttaagttcaggatgagtactgattatactatctggatcaataccgtaccagtcaaaaacatcttcaatcgctgcatcaaaacctttttctgtccgttccaaatcgcgtacacattcatcaccagtcttattgcaatattgattgacgtttgataatatatgcgtcaaatttttgaatacctcttctgtttgtggcaatatcgacaacgaaaaggtctttgcaggcctcgaaccccatataatcttgcctgacttgatctcttgcgtgaaattattccccatatcgattaatagccttgctggcaagtttttatatgcgggctgccagtgtgtgaaattattaccgtcgataaccgaaacagcaacatcaccaggaacgccagctgttaggttagttatttgctttgcttccacgaggtttccctcaagattttttttcggaatatataacggagtcttgaaaacgtccccaggttgaatggtaaaataattcttgccagtaggaacagatctcctaccatgcaaaatttgtttgatgggatcagtttcttctgagtattttacgtcaacatctggaattaaggttctatccggaaccttaatccttatttccttggtcccatttttatgaataatgatgccctccgtatcagtgataagaacgtcaagtacctgccccatgtacttgaaattgttaattctaataccaccaggaagtaatggcaactgtatgggattgaacttcaataaccgatgaatcttacctgtatcttcatcaacttcataagagtatcttaaaccagttaaaccgaataaaatactttgaaggaatccaccatttgcagtcaaaaatgggaacgcaggttgagttaacccattggttaggaaattatcatctgattgttcactaaactgagcgaacggagaccttaaataaggaacaacggacttgtatagatagctttgtgatgaactcccataattcaataaactggctgctccggcgacaaatactggatacgtcatagctggccccgatgctgactgtcgctctgaataataatacaaattcttgatagcattattcaaaatggattgatctgtaatataacttaagggatatatcattaacaccacatcggcttgcttaatctcgacgctgctattcattccgctgtattccaaagtgatattggtctcagatatcggaatatgaatattatctgcaatttccaaccactgagggtcagggtcgattcctaaatgtctagcaatatcgtgtgcccaaaccatgacactttgtattcctgcattggtgaaagcagcgttatcgacgaaattagcgtactcatctggatccgtaagattatgagtggtgtactgttgcatggtatcgttccatttcacgtattgtgcaaacattttagccgcattttctacaaatggccacgtagtatacctcaaatattcttctgatcgttcatcatcttcatcaccattcatatatatggcgaacgagcttaaggcgatatcaacattgatatggtattcatagtcaacacaaggtccagttgatgtgcaatttgcgtacctgccagatgtccatgggtacagtgcaccatcatatccgtatttttcagcatttaatttagcttgatgcagtgatgcattcctataattattgatttgccgagcagcattaggaaagaaaggcaagagagctgggagaatccaaagatcagagtcccagaacaccattcctccgtaagagtcactagacaaacccgaaactcctattggtagcccacggtcctcagatacattatgggaccttgtatttgccaataagtggtagatggaagattttgctgtcatctccaataatccatcactgggaatttcaatcgaggcatccttatatattcttttccaagcatttttgtgtgactgtatcaaagaatcgtagtttcctttgttatctaaaacgatggaagtagccctttccaaattggacattttaagtgcttcattgcttgttccatttgaattatcatccggttgtttattatcatattccgatgatataataccgatatacttatgagctacgaatgttgaattcgcttttaaaatctgtgttgtacattgactaatagaatctgaatattttgataacgtcaaagtgtcccttgatggaatgtcaaagtatgaaaatagtgatgcgttcgaataggggacattttccggttctacaaccataaatataccctcattgttctgatcataaccatagtcgttcaacacagtacgatgtgaagtagaaaagttcaaggaatcgcatatttctaattcaacgtattcattttcattatcagcggaggtgtctgaattattatcaaataaggaaagctccaaagtgactacacccaaaggataaatttttctgtgagctaccacttttgtagttaccaacaattgtttgtcatacacaaaagtagtagttacaataccatcttgcaaagacaaattttgcatgtaatttgtaattttatccaatttgacatcggtagggttgatatattctatctgccctgtcgtggtatgtttcaatatagacaagtctgtccattgtggtatggttgatatcactgtcgaataaccgtcatcatctagctctgggaaattagtagagttcaatttttcttgaagacagtagaaatcactgatgaaggcaccagcaaaccgttgatttcttagcggccagccattatctagtgctcctggtatagaagaatcatttacccaaacgtttattgtatccaaggcataaccaaatccaagatttgggatacgagaaccgatgtaaccattcgccacgtacggttgccttgagaaagtattttcagaaagtagaagattaccaagtatttgttgctcttcatcatagaaagtattttcatggtccttcaataatgaatacattttctccgaggccttcctttgggattctggacagaaaagagtatcctcggcacaaacaaatgaaccaaaatgagtatgctgcagtggcagcggtttcgtcaggtaaaaataaattggtgccaaaatggccactgaaaacaaaatgaaaggtactatcaacattgtgaaagtgtaacgtgggatgttctgcaggcaggctttttctttgttttttttttactcacgaactttcaatagaaacttcggcgtctaaatgttgcaatgaactggtttctttttagctatcgatccttatacaaaccaaggatcactttcacgatatgctgctgttgcctatgcaaagataaatccaatgtatgcgatacgattgggttaaggaaataaagaaacagacactttgtgtgggtatttacctgtgaatagtagaaagcaaataaaataatgacaatcaccagaaataaagcgggcgtcgattaattaatgctatttttttgaaagagatacacgggttcgacatccaaccggttagtgtatattggaatcttggtgatatattttgttggccatgacaagactcacatcctttcgagagcaaatagtcaggtagatgatcaaagatgtttatttatagtttatagtctaactatagaacccgaaatctgtctcctcactgtttgctcccttgtttccattttggttaaaaaaaagttggggcaaattttcccggattcaatgaatattcaatcacgtgacaagaaccctctaatcaaagtcctatcgaacgaaccaatcacagctatatgccctacgtaagaagagggagagaaaaggaagaacacgaacccgcgtgcatcacactgtttttagattacccggactgtatagctgtgaaaagcgaaaaaataaacgttaaccctcattaccctgcccgaaacaaaaggcacgtattttgttctgattggccaatacagatcattatatacgacactatacaaacacatacacaagagacagacacagtatgcaagacagatttcatatttcggcttgaaactcgaagcaacccaataagtcttacagattatcttcattggtttctaatcctttaccttatcttttgtcctcttgagtgaatttcccaattttcccatttcccggcttccattgtgtataattggtctgtttcaaccagtaggagcgaaaaaaattttttttgttaagagaagacgctactctgctcgttaaaaaggacattttttaagattttcaaattgcactgcactggattggactagcttggcaaggaaaggatgcatacaattcttgccaaatagtgcgtgcgaatgatatctacgaaatgctgtataaagaattatatacttgtttccatcccacctggtacacacgtagcttagcgttaccagaccaattgactttccttcttgaaagcgaaatctgtaatttcttccttctgttaaacaggggtgttttcgtttcaattaattagattatatttccctcctatagtattttatcattttttttttttttcgagaccaagttttcatttgaaaaggaaaaaaaaaattaagacaaaagaatattgatttattattcatatattcaattctgaaccaaccacttagttctcattaagatagttgggttatacggttttaacgtattcaattaattgtaattgcaagtgttcttttcgttcttagaactcaatcaacgtttagaacaatccaatcacactcacacagttttttctgtaataacaatgttgtcccgttctgctattcgttctgcttccagatctgttgttgctgccaacttggttagatccatgaacagagtcgccagaccagctttggttgttgctggtagaagatttgcttctgctaaggctcaaccaactgaagtttcttctattttggaagaaagaatcagaggtgtttctgaagaatccaacttgaacgaaaccggtagagttttagctgttggtgatggtattgccagagtcttcggtttgaacaacgttcaagctgaagaattggtcgaattctcttctggtgttaaaggtatggccttaaacttggaaccaggtcaagtcggtattgtgttgttcggttccgatagattggtcaaggaaggtgaagtcgttaagagaactggtaagattgttgatgttggtgtcggtccagaattgttgggtcgtgttgtcgacgctttgggtaacccaattgatggtaagggtccaattaacgcttctggtagatccagagctcaagttaaggctccaggtatcttgccaagaagatccgttcacgaaccagtccaaactggtttgaagtccgtcgatgctttggtcccaattggtagaggtcaaagagaattgatcattggtgacagacaaactggtaagaccgctgtcgctttggacaccatcttgaaccaaaagagatggaacaacggtactgatgaatccaagaagttgtactgtgtttacgtcgctgttggtcaaaagagatccactgtcgctcaattggtccaaactttggaacaacacgatgctttgaagtactccatcattgttgctgctactgcttctgaagccgctccattgcaatacattgctcctttcactgctgccgctatcggtgaatggttcagagacaacggtagacacgctttgatcatctacgacgatttgtccaagcaagccgttgcataccgtcaattgtctctattattgagacgtccacctggtagagaagcttaccctggtgatgttttctacttacattccagattgttggaaagagctgccaagatgtctgaaaagaacggtggtggttctttgaccgctttgccagtcattgaaactcaaggtggtgatgtttccgcttatattccaaccaacgttatttccattaccgatggtcaaattttcttggaagctgaattgttctacaagggtatcagaccagctattaacgtcggtttgtctgtctctcgtgtcggttccgccgctcaagtcaaggctttgaagcaagtcgctggttccttgaagttgtttttggcccaatacagagaagtcgctgccttcgcccaattcggttccgatttggatgcttctaccaagcaaaccttggctagaggtgaaagattgacccaattgttgaagcaaaaccaatactctccattggctgctgaagaacaagttccattgatttacgccggtgtcaacggttacttggataacattgatatttccagaatcgccgaattcgaaaccaagttcttggcttacttgaaggctaaccacgacgaaatcgtctctgctatcagagaaaagggtgaattgagcaaggaattgttggccaccttgaagtctgctaccgaatcctttgttgctactttctaaatgatttgattcaatctttaataaaaatattcaatatgaagggtgaaattttcaaattagaaaatccaaaactcaatagaatctaaagggtcaccggggtccgatgaagagtaaacagtgcctcccactggccaaaactctttattgaactacagttggctctttctagcggatcggagtttttctaattagcaggttttatcccacatttttttgtcaatttaaatcaatcattatcaaacaagtaaaattaaaaattcgaaacaatctaccatcgtcaatctgttgaatgaatttattcttaaatcattatggagaatttgatgctggagatagatttgttatagaaattaaaaaattatcctaaacacactttttttttgaattgaattctctaaaaagatcgaaaacatatattcttatattatcatgcaacaaagattaggaatgaagaccatcatgtgaaagctggaaaagcatatgactttaacgaattggatgagtattaaacaatctcttttctaagtatattaaaaaataaataattttttgtagattttttgtctaagaaaatctcagtataaattttaaaatcaaaattatctctatcaatcataaaagaccaagtagaaggttagggaaatgttaaaaggaagtgactattcctcagcagtaggctcctctattactgagtctcgtatgccgaacatgtctgcggagaattctacggtagaacccactcctgtacctgaacccactcctacaacagagacaaagaaagctgaatctaagagaattactgatgatgacctatacagacactcatcgcaatatagattatggtcatttacaaaggaacagttagagagcagaaggcgagctttgaatgccaaagtcgtagataaggtaaatgaaaaactacaagatatcatttcgaaacacaatgacttatctcaggaagagttgaatgctataaatgaaaaggcggtgccagtaacaatggaggaggaactgaagtttgtcaatttttttgccaaaaaagtacaatccttttgccattcactaaatttaccaacggaggtatgtgctaccgcgatatccttctttagaagatttttccttgtaaattcaactatggaaatacatccgaaacatattcttttagccagcatatttttggcatgcaaatcagagaactattttataggtattgaagcctttgccaaaaaaactaagtctcaacccacaactattcttaagtacgagttcgatgtgctagaatcgttacagtttactttgttaaatcaccatccatacaggccgttgcatgggtttttcttggatatccagtacattttacatggaaaagtcgatttaaattatatgggccagatctacacaaattgcaagagaagaataaccgaaactcttctcacagatgtagtatatcattacaccccaccgcaaattacacttgcatgcttgttgatagatgatgaagcgttaacgctaaaatacttggaagtgaagtttgggagccctcctgaggagcaaaaggactcggaaacggaaggcttgaaaacggaagaaacaccatcagataccaaattaccatctaatttaaaattgcaaactttaacagcgctaatacgagagtgtcaggcgatgattttgaacgttgaaacactttccaaagaagaggcaactaaaattgacgcaaaattgcattactgccaaaatccaatgctgctggtagataggatgcgcagacaaaagcaacaacgtgatagctccgctgagcttacaacggaaccggattctaaaaagttgaaagtgtagtagtatacaagttaagtagagttctcaatgaaaacttcctaaagttcattcattcatacgaataattgttatacaaatatgcatatatacttgcgaagagaactattatcttcatttatagtctttcgacaggggtaaagtagtgactgccgcttcttcaagaaggccggccaatgttatatttacaagacacgtcaatgcttttatgctttattatgtgaaaatgctatgatctgtaatttcatataacacttttaaaattaaccactcaatttgggtattctgtacaagttgcaacataaccattgtagtggggttcttcaaacaggtcaaatgcagatacagaaagatggtcggtgaaatgttcaatcaatggtgtaatgctaggagtccgtatccaatgacgttttagttctgcgtctgatcatgctttaatcagtaccggaatttttgatttatcaccgccgatttccttacgatcatcgctgtctggtccttcaaccaccgtagtagtggccattttcattttattgataggttctcctttgcataccttctgaatttcggtactatctaatgtttcgtattccattaatccttgagctaatctatgcaattccttttccctttctgctaataaggctctcgtcctatcttctgaagctttcaaaagttcaagtacttcgttatcagcaacgtcacgaatttttccagaccatgagtcccacttatcagccaaatttactggtccgacttgttcactcataccgtactgagtaaccattgctctagcagtgttggtagcattttgtaaatccgaaccacaaccactggtagtattttccttaccataaatcagttcttctgcaatcttaccacccatgcacacatctaacctagctagacattctttcttagtgatgtccaccttatccatttcaggaagttggaaagtgatacctaatgccctgcctcttggcaagatagttgctttgtataatggcgttgccccggcagtgtacagtgccatcaatgcatgcccggcttcatgataagcggtggctcttttagtagcttcagtgagaaccatagttttcctttcagcacccatcaagattttatcctttgcccattcaaagtgctgcatatcgacagcaatagcatttttctgacaagcgtatacggcggcttggttaactaaattcatcaactcagcaccagaaagacctggggttcctcttgcaatgatagttgggtccacatcaggagcaacagtaaccttcttcatatgatgtctcaaaatgtcagcacgcccgcgaacatcaggtaagtcaacattgacgaccttatcgaatctacctggtcttgtcaaagccttatccaatgattctgggaagttagtggcaccgatgataattataccgcttgtttgggaaaacccatccaattcaaccaacaattgattcaaagtttgttttgcgtaagcttgatctttgggattacgcttacctccaatagcatccaattcatcgataaagataatagcaggggcacgagcgcgggcctgtgcaaacaactctctgatacgcttggcaccaacacctacataaacttcgtcaaactctgaccctgacatgaagaaaaagtcaacaccagcttcaccggcggtggctcttgccaataaagtcttaccagtacctggaggtccggtcaatagaacacctttaggtaacttaccacccaaggattcgtatttggtaggatcttttaagaaatcgacaatttcctccaattcagctctagcttcgtcacaaccccgcacgtcatcaaatcttacattagtctttgcaacatccacagatttatcggcgacttcatttgtcttgaagagggttgaatgttctgtaatgtatttgaaaccttcagtcaaaccgtatgtaactgcaccaaatacgatcaaccattttaaccatctggaaacaatagagaatgtggattcagtgacaacaacatgtagaggttcctttttggatcccatgtacggattatagatgccagaataaccagatgaaacacctccagtaacttgggcagcagcaccgttagccgatgcagcggaagaagcaccagatgaagccacggcaggaggaatacttccagctggagcagtcgtcaacaaagtctgcctcacagactcagcatcagcgtgcctaccgatcctttgtaaagcttccatatacaaagccatacattcaggcgatgaagtaataccaggagtttcaaatctcgaaacaacgtattgcggatagttcgatttcaagagaagtttatagaactccgcttgcgcacttgggttagacaaatctttattagcttgctgttccttagtagccaaaacagcgtgtgatacaggtccatttgccggatcaatatcactcgaattaatcccgtttagttgcttgggctgctgaacattttctgcaccacttgttgccccatttacagtgttcttcgagtcctccgaatgctgagaacctgtaacaccattatgatccttgcctgtttggttcttgtccgaatataatctgttttgtagcacgctgcctgtaagaaaatgctttctatgcaaagtccttaaaattggccctgtcaagacaggggcttgacgaatcaacactcgagaagcgttcttggcgcacaaaccagaaacaccaatcaacaccggaagcgtcatctagcctttaacacttaataagtacaccgtaaaagtgattttttcaaagtacctgagctggtatatacaactttttcgttgcttcctttgttcactattcttaaaagccttttgcctctttcgttgccttctaaatgacccgaataatcatagccatatatatcctcattctaaagaaaataaaaacctttaaatttgacaaatgctcaatttactcaaatttcaacattatcaacaaattcttggaagctgatgaacgctcgtccgggtggcgttgcatttcattagggagaaactctacgtaacagctgaaatccgattcgaaagtgccagaaaaataaaaaggaacgaggtctttttagacgaacatcacgtgatcaatactcttctatatacaaacaaaataattacgtcggctatagttcggctactccttgccaataattgcgtctgcaatcttttcagggaaccgaatgtccaagtcttggtagtttgtagtgtcgttaatcgtaaatccatactcattagcgaggtgaagaaggcagataaagcagaaactggttgagagatcctttttggcacttgaagtgtacatgttcacgatatcgtgagcgatatcggtgaatttcaagtcatagccctctgcttttgttgatatttctgctgatatatcctgctttccctgcttctcttcggtcagatgtgcttctgattcgatatcattctgagtagtttcctcattccgagtagtttccccattttgttcgtctgtcttcagtacatgtaaacgttgccatattgacttccacacattattcttcaattttctcacatctacctttttggaggttctggagtaggtcattttattatttgcaactaatccttgcgtgtttacgaaatcttcttttgtatccatatccaaatcttcatcttcgaaggcttggttgaagtcaatgccgttatcctcttcaaacgatggattggttgatctttctatctgtgtgtcatcttgcttgtgctcttcttccctttcatgcagttgatagttttcagcccaaaagcgttcgtctgcaatctccggaatattactcacttctttgatttcggtatcatcaaatttcagggacccaggtaacctggctttactgatcctcctgtgtgaaaagaaactcatcttctgctcgggcttaatgaagagccttgtgattttatccgttgtgaatttatagtcgtccggtagtaagaaatgtgaatcatttgttctttgtttcactgatagatcaatgaacccctttttatttgcaaatatttcttcttcaatgttatcattcagatccaagaaatcaatctcaaactgttttttgggtaccttcttttcaactgctggttcatgattcccatcggcttcagttggctgctgtggtttggccacagactccttgctaagtttatccttgatgtttcgtaccttccagtgttctctacccctccaattctgacctatcgctgcgtcaaagtaagatagtaactcttgatcgagtacgctcgcatcgccatacgatttgtcatctatttgtgacatattctgttgatttgatagggccagctgttcttctggttcgtgaatgttatccgctggctcaacgtagtccatagaacctgcatcaacagcaacatcctcaccatcctctggtggcatttcgtagttgaactctgcctccgcatcgagttcaggaagggtctctagatctttttctgtcaagaatttatcagattggccattcactccttcaacaaatgactttgcttttccaatatccgctactgcactttggagctgatccatcgatggacacaatattgaggtttcaatagtattaaaatctaagaatttgacaccgagatctaatatatcatcctctagcaatgtgactgatgtatctggggttgattctacattttcctcatttgctgaacccttttctgaatccaagccaaatacctccgaggtctcttttgctgattcgctgacttcattattttcttcctgaacttgactttcagtagaggccaatggttgcggttgttcttgttcaggttcagtcgttgttgcgtcaaaaacaactcggagtttttcatcaacatgtaacgtgtttataagtaagctcttcgcaccaccctcatcaaaatcggcgagtgccttcttgaacaacggatctatacttaggttttgtgctaaatctttcagtcgtatactttcaaaatcaactaacgtcgtttctaacactctattgtacgtccttttttttttcgcgagagtctctgggtcatcacgggcaatcggcagaccagttaaaggatctacctctagactgtcatcatcttcctcatctccatcatcgttctctccgtttgtattggatctaatttgcctccctttccgttctgccaatccacttagtaacttccctgtttcagtagcgacggaatcgactctatgagagtagattttcacacaaccgtctaacgtcgccgaagccttctggaaattaatattatcctcctcatctttcaacacgttcaagtcatgaaaatagtcaattaatgcgaaattccaactgtttcttgagttgattttgttgtccgtggccattttgatccattcttcaaagttagccatcatagtggacttattcgtgaaaagaccgttgtcatcatcgtcatacggtaattgggtagtcattgctactcctgaaaacctaaccaaggtagctttgataaagcagctgaataatgctcacaattatcccgtttcctgacttgcctctgttttcctgaacagctttaaatggatctgaatactgcgtcccgatccttcaatgtttacaaaacatcaaataaacgtaaacatcaaatcgtgattagtgactaagtttccacgtgagaagcagctgcataaagccttggtttgaacactttaggagcatctcaagcgtttcccatgatcacatctaatgcatctgattcgatttttggtaagtatagtcattaatgtttgcaatcacttcctggtctacatgacttcttcacttttatttcaacatgtcaagatattagctagaactttaaaatttgtttcttacatttaaaatatcacattaaaacattactaactagctagataaatatctacttaattgaaagttcaacagttaagctattaaacagaggaagacaaaggggaattagagtgaatttaaatacaccaggcattctgttcaaattctctttaattcgcaatattattacttgataagttatcaattagtgtgaaaagcgatgacatgatgatagtttgagctagctttatcatgcaaaggaggttaatttctaccaaaaaatatttctactgacataaaaatattaagtgttgagttgattttagatctcggtaacttccaattcttcagcctcagccttttcgttccattcggcagccttgatggccattctgtggtgtttatcgagtggtggttgtctcttaacattctttcttcttaggaggttttcttgaatgttaggccacaattccaatagttgatacttggctctaacccttaatggtacatcaaacacttcatccaattcttccaaagtcaattgctttgtttcaggcatgaagaagtagactaagaaccaaccgatgacgttccaagcagcatagaaaccgaaggcaccttgaggctcgaaggcacgtagcatacttggccaagttaaagatagaatgaagttgaaaccccacaagacaatggtgaaaagagatgcaccaatggcacggacgtacaaggggaaaacttcaccagcgataacgaatggaaccacaccacaaccgaaagagtaaatggcagagaatacgtaaatacccatcgaaacaacaccgattcttttttctgtatcatcgatccagaaagaaaaccctgtaatcaaaaggaatactgccaaccatgggaacgtgtttaatagaaggaatcttcttccaaatctgtcgatcatgaagaaggcaggaatagcaaagaagaagttaattaaaccgaagcctagggaagcacacaatgaagaaatttcagtgaaacctgattgcaagaaaatggcagaggaatagtacgcaataacattaattgcacagaattgctgcatgaaggcacaaatgaaggcacaaatcaaggcgtttctgtttcttctaacagtgaagatttcccttaatctagtccagtaagacatttccaaagagttttcttccatcaacaaaacgtgttgatagaaaagatcacgacaagctaggatcttgtgatttctaatctggagggtggattcataagcttccttgtaacgacctttacccattaaccaacggggagattcaggacagaatgggatttgcactaaaactaaaatagcaggaatcatagcactggctaacattaatctccaattcaacccaccggcaataccagctcttccaactctgtaaaagatcaaagagaaaacgtaaccccacatgataccgaaagcagtgaaagtttgccagttcatacagatgataccacgtaactttttggtagaacattcagccaagtaaacggaagtcgtagcactcttaggaccgataccaaaacccaacaaaaatctcatggcaaacaaatagtgccaccctggagtaccagctggaccgaaagcttgtaagaaacaggtgatagcagagatagcacaagtgatgaaaataacctttttacgaccaaacatattgttcaaccaatcggtagcccaacacgagacaccagcacaacatagataaggtgcaccgttaacaagaccttccaaccaatcgtccctcttggatcctgaccctaaacccaattctttagggtagaacaagttagcaccattgataacagtttcatccataccttgcacggcagcacccattgcactggcagcgataatagcaatcaactttggagggactctccaaggatgatgaatttcatcgtaacaagcaatacgttcatcttcctttagaacatttaacctgtcgtattcgtttggttttctggccaaagcagcaccacgagcgaaaatatcatcatcatttggcaactcgtacttcttagcaaaagcacgtcccatgttcataacctgctcttctgaatattcagccaatatattttcttcttgcacactattcggatcccttccttctggatcttcaccaatactagaaatggaactgtcatcgttcatcgcaacgaaaacaccaccaccggcagatttcctctttgcctcatgaaagctggtcacttctgcattcgacagatcagcactcttcttggtagatgagttaacatcctcaactgaaggactactcttaacctctttattatccatgactattttgatactaacaatctttctctatctgttcaataatattctgcttcaagacctcttcacgtaaatcggttaatggcctttgtacaagtttttctaagacaaattcaggaaaaacaaaacaactttataatgcaaaaactatatgaggataaaccctctcaaaactattataggtttttggttgttatgaaccttttttatatgggaggaagatcatggaaaaatatttgacgtaaaagtattaacagccatgacaacacgatctttgagaaaagtatatacttcagagcctacttatatatactgtctttcaattcaggttctccgtgaagccgtgtaaataacatagctaacgttgacggaagtaatccagttttcattttgcagtggtgttaagcgctaccggctactaacagggactaataatagtctccaacgcaaaaatgaatcaaaaaaaattcaatcactatttgcttgcagtagcgagacgatccaagcaaaagccagagatgaaaggagccggactatactactgcctttgcttgaatgaatagagtcagcctaagtgaatattaaggttgttttttaagcagactcccagtttcataaaaggaaatcacggcaaaatacacgaaccgcataggaaaaaaaaaagaaaatgaaactaaattacgtattagaaacacctaatcaggtgggaaataatccagcgcaccagcgatcttcttcgagagctaaggaggaattatggctggttatgagaagatgaggctgcaatagcccagcccacgcgaatgggctgaaacgcaaccgtcgattatgtcgaaggctggagcaacggagatactattgctatgattccatagtagttcgagcattcaagatcagatgagtttcgagtcttcatgaacaaagagcaaactaaatatgcggacttgtaaacttacagtaagaaagccgcagtagattttgccagtggtcctcgatgatatatatcatttttccatggctggaataattggaaccaaaaggaaaatacccttgcctcaaatttccccgcagcatatatttttgtttatttccagtagcaatttattttcaaagcactcccagccagttttgtatgtaacttgtatacttgtagcaaaaaataatatgttccgaagaaaaaacgagaaaaaaaaaaaaaaaagatggaaaaaaaagatgatcaagaaattagaaaacattgttcagaactagaggtatctctagtactgttgggatgaatttttggcggaaaactcgaattcgaatgtagtgaggatacggatcagatactggatatggatttgggctaggcaattgcaattttcattcacgccgcttttcaaacaattcatgtggggggaggacaatattattttccccacaggaaaagtggaaaaccggaaaagaaatgcgggatgacgaattaatggatatttacccggtgtactgggaatgatagatcacgtggttagaaacactctggtgcgtgttgttttttttgtccacctcacctctctctactccgctccacctaggtctaaaaacaataattatcaaagtctggaatggtttagggtagggtagggtaggaactatccgaaaggtttaaatggttagcatcaagcattgctccagaagtaactgattatacctggcgtgtttgagagaatatcccgaagcaagttttccaagtttgagagttttgttttcagtggtcgaattatgagcgggaagatttccaggtacgttattttacccttaacggggttcacattgggcttcggatatttcgttaagccatggcatttggatgaatcagcactacaaacgttacatagaccgctacaggaccaacggaccgatgtattggataaacttagggccacagaatgggtcaagaaacttaaagagtcgtctgattatatgatgcatcgtcaatcggagaagatccctgtacctcatagagattatcacgtaggtcaagggttgctttacggaccaactaagcttgaaattgatccggtggtgtttacagataatgcacagaacaagatccacgtcatatatcatttgggccacaatttaggcaacgaaaagaatgcagtgcataaaggtgtactttcattgctattagacgaggctttgtgtttctgcgggttccctacacttcccagtaagcgtggagtcactgcatctctagacatatcgttccagaaggatgttccagttaattccaccattgtgctcaacgcccaggtcattgaaaccaagggaagaaaatgtatcattacaggaacgttggaatcaccacctcttgatccttctacgaaactgggatccgtaaagtccttagtggctaagagcgtacccaattggatatacaaccctaaaccgaccgtctacgctactgcaacgtgtattttggtggaacctaaatggtttaaatacgtttcatggattaacatattctgatctaataccaccttaaggtctccgttatatatgccaataatattatatttagttcacatactacaacattcaatattaagtataccatatgctagcattgtactggtgctcggacatgatgaataccagttaattcatcatcccattcccactattgtattgtttggtccgggtaataataatacagactattcatatctgctattttctttgacatctttaaattgaaagatcgaatttctaaacagaaaaggttttaacacaggacagaacggttattcaaattttggaccgttaaggaacgtagtttttggtcttagttaagttttttacactgctggtaacatcataacaggtgcaacagactactgtacacactttgagcgcgggagggacacgccgaacttacagaagtatttttcgcaagttattattaaggtggtaagaaagcgtgttattaagtactctgttttctaaaattgatacttaagagttttttcttgcgattgatctagcttttgagatacgatctgaatttaccaggataatctgctacaggaacgtgaatctttattgccgtatcttagcatcaacttattaacttaacacaagggtgtttttttttccggaatttcagcatttcattatcattacaagaggatttattttaattaaaccatggctagcattgacgaatcgggagaagtgtactgtgacaaggaagtcgtgactaaagtgtttgctagactgacaaccaagtctgaaaacagggcatgcttcgactgtggcgccaaaaatcctacctggacttcagttccgttcggtgttcttctttgcatcgattgttccggtgagcacagaaatatgggtacccatattacttttgtgaagtcaagtaatttggacaaatggactgtcaacaatttgagaaggttcaaacttggtggtaacgataaggcaaaggattttttcttaaagaacaacggcaaacaatatttgggttcttctagcaaccggatggctaaatatacaagccaggtagccaagaaatggcagagccatttgaatcaaaaagtggctagagacgctgaacaacatccaggtgaaattgtattttcagcagaagatgaacaagaattcacagggggcagttctggttcttcaaagagcaacagcgttgatgatttcttctcaaactgggaaaagcctgtaaaccaaagtaacatatctttgacgtcatctcctagaaatttaacaccaaccaatactggcaataggaatggttcttctattctgtccggaagtggttctgccaacaaaaccagcaacggtgctagatccactacaactaagagaactactttgacaggatcagcaggctcttctcaagcaaagaaacattccatcctttcctcctctcgtaagtcaaagaaaccggttgcagccaagaaggtggatgctgatttgtttgatcaattcgaaaaagaagccaaggaagaggaagaattggcctcaagtctcgccaccacttcccttaactccaataatttatcgaattccatatacgatgccactcctgcgccattccaacaaaaatctggtttcagctctagcagcaaaataaccaagccatctaccaatgtcgaagacgcggaggacgacgaatggtccaacagatacaatgatggtattactttcgatcaaatcaatgcttccaatgtaggattaactggaagcaaagatgcggcaaaaccaaagttggctaaacttgggtttggtatgacttccaataatgcagaaaaggaacaaaacaaaactaacgaatcaaggagggctgcctctggtccaaagtacacaggtaagattgcccaaaaattcggagaacaaaagggtatctcttcagaccaggtgttttctcgtggaagctacgatgacgaggcaagtaaagaagctcaagaaaaactcagacagaacttcagtaatgccacatctatttcttcagcctcatactttggcgaaggccagagcgaagatcagttcgacgaatttggaagaccattgaatccacaaaatggaacaagaacaaacagaagcggttctcttggcggacgaaacttcatggagttcacgtctggtgctgatgacgaatttgacctgttgaagaacgctgttgaacaaggagcgcaaaagctaggaaactacctaagagattacatgagaaattaattcctatgttagtttattgtaagataaagtatagtcattcatcaaggagttaacgttaatagtatcagtgccataagttccccataagttcccttctatgaaaaaaaatctgaacaaaactttatggctttattgtaatagaaacaaataaacaaatagatgaaagcttgtccttaataggatacccttttcagtcacacatctcttcgttgtaccataatatgaataccgccattatttggataataataaatataggatcattccaaacacccagtgtgtagtcagagtttgagatttttcaacacacctacattttccaaggaataccaagtgtctattgtgctttacgtattatttaatgattatttagtagcttgagtagcgaaataaggattatgcaatccagtgatcatgacaattattgattaagtagcatttagaaagttgatttaaagaatgatatgttcttgaaagacaagaagattaaggtcgattcgaagtaagatattaacgcgtagtcatgggccataaacaaatcttgtcatgtcggaggtatatctcgtgtacagttcgagaagaaagaggtgaagaaaggagtaaatgaaagtcctgctgaaccgaaatactagcaacactagcggtatcagtggaaatcgaaatgaaaaattaatgatctatcagaaatcatggagaaagaaagaaagaaaagtaaaagccaaccaaccgccagcttctctattcaagccttcttcttttcatatcatctggttgtaactcagtgttaggagaagccatcgacgatccgttcgacttatactttcttttcttcgttttggtacctgtaccgtttagatcgaatgcaagatcatccacatcgaaaccagaatttttaaactctgacggatggctcttcatcaactgccctatcactgtagagcacatatcccaatccatttgtggcggctcaaataatcctgtatctcttttcatcatcgcgtctctatactcttcttcactcatcccttccactagtttggcttgattcatcatatccggattattttgaaagattacgtctgatatctctccaccttttccgttttcccttgaaggaattgttataaaccttcctgaaagatcttgtatctggttcttgtaagatttccttagtttaaccgctttcgtaccatctgcattcgtcctagccacctgcctagccacctcttctaaaccataaatcgttattaaatcgtctaccggattcggttgttgtgattcgtaaacaggaagtgacggatccacataataataatagttcgggtgcgtggcactaccatcttcgtgactcgtagccattttgtctaagttcactgtgtattgtttaaccttgttttgttgccttgtttgtatttggaaagttgctaatttgaaactctcactatctattaggacttattctataatcaagttaaacccagaacaaataaaacaacagatatatatcaacttgaatctcagacttctgcggtttaaataattcttatacaacagttgacacgtaccctctaactacagatacacagatcccaacaagccaacaactgtgtatttccaaagccaactttatactcaatgtacaatctcaacgtttaaattctacatcgatttccatctgtcgaaaatgcatgtatggcatgtaaaagtttccggattccaacatctaacaccaaaaggaacgacactggcagtaggaagaagaggagaagctgataatccggaaaaacttctttttttcagtttctttctttttactatcctagattaggactgtctgttcaaggaataaaaaataggagaaggcaaaaacccagacatcggatatattagaaggtgtatgggtggaaatgacaatatcactctggacttttggatgattcctgattaggaacatgtatcctttgggcgggaggatttttttctttgatttttccgtgatccactcactgctgcagcgggacccaggcaatggactgagaagggtacacgggaggcagatccaatacctgtcggtaggctggcacacccctttcccgttcgctcagcttggcaatgggctaggcagagagggtttggcttccttctccccagctcggacagtctctctacctgtggacagaggaaggaatcagtttgccaggcggagaaatatggtagagggaaagcgggcctagcagcaaccagtttgtattacgttctctgtagtttgtgtgtctggaactttttggtttaacgaaatagtataatgttgaaaagttgagtttatacgttatatatgaaagtactgttaatggtattggtataggtatcagatagaaagactcagcaaggaaagaatagttcaaggtatgtacatagtggtacaatacgtgcggaatagaaatgagaattgatatgcgtttcgaacggccagatgtagacgatatttgagtgagatacaatgagaagcaaaaaaccaatgagtttaactagataaacgtgggatatctatatcaatgagtttataacatgttgattcagtgtcttatattcatccatctattaccgtggggtagaaatgaaattatttggtatgatatgatgagcaatgtgtggtttgtgatttgtaagagtactaaaaatcatacgatataaaactaatgactggcaatgaatgacaattgttgtaatattgaaacaggttattacagtggggatctataacgaaaaatttgcctggattcttaatctagaatttttaagatttccatgttttattaatattagacaaactcaactcatccttatacttgccacaatttgttcactttcaccagttcatctcagaagaaaaagctcattaggtcgatataccgtttgctatagaggcatagtggaatagcacaacatccgctctatcaggcaaaaaacattaatactaacaagataacaatatttcgatattactttaatttttaaacagatggctgcttctctacacccaaagattgttaagaaacataccaagaagttcaagcgtcatcactctgaccgttaccacagagtctctgaaaactggagaaagcaaaagggtattgactctgttgttagaagaagattcagaggtaacatttctgaaccaaccatcggttacggttccaacaagaagaccaagttcatgggtccagatggccgtaaggttgttcttgtctccaacgtcaagggtttgaccccattgttgatgcacaccaagaccttcgccgctgaaatcgctcacaacgtttcttccaagaacagaattgctatcttggctgaagctaagaagaacggtatcaaggttaccaacgctaaggctagattggctttggaagcttaaatgttttaatatctaggtttttaaattgtcaatataaactatcaaatcacttcttaacataatttctctcatattgaattgaattgaattgaatacataaacatcctttcgttcatttactcagcttactcaactagtttcactgtcatttcacatttttatatgtttgacgacggcatcaagcgtgcatttttactcactaatagttggactttccacgcagagttgagtgctgacatcgtatcgatgtgattggaattacaaatatatatacttcatgtattcagtggatatcgttgtacctgtagctagttaaagacaagggtcggtggtattgtgccaaatagtaccttgtccagctcattgcaattgagaaatcatttgatggcatgcgacaaattgaatataggacagttgccaaaagagcctctataaacagaagaaaaaaaaaggatgtaaaaagagccagaaagaaaagtatcaatgacggttgctgagtatattgggatcaatttgaaggagaattagttcaatatctttcgtctccctttgttttcaatgagttgtttcaacgaaacaacgatgaaaagaacagctgtgtcacaagatgaacaatttcaatactaactcaaatatcttgtcaatgtcttggctaggggaaaacatagtactaatggctgtaatgataatacaataacaataatgaagaatgattttagccgcatgaagaaatcctgcaaagaaaagaacaaacaggttaaaaagtacgggggtaattaaaacaaaagaaacagacgtagataagaaaagaaatacgaatataattcataacaacatttctatcaaagtcgagaaatatgttgtcatatattatacgatggttgatagttccctcacttaatcagaatgtatcctaagataaccaataccaaagtaagaaacctataacgatccaaatgaccacggccggtgcaatattcgacgtactagcgggttctgcaataatttcagtgttagcgctggtatcagatttgaccttttcatcgagctttggttcactttccacaacttttggcttttcagtatccaggtcagtattggcagatgcaaccgggacagatttcttttgtaccggttcactagcggactcttctgtagctttcgaaccactagcaatagtttccttggctgaaggaatgacagtctcagtttgcacgttatcagtttctagattttccacgactcttggttcagcatctagttgataatttaccttaatcttctttgacaggcccttgttcttgaactctgcttccaattgaggccaagcttcggccacactcagttcacctaaatcgtaaggagctggcaaagctataaccaagaatttatctttacatttgaaatctggtgtaggttcttccttcaatcctaaaagaatcacttgaacatcaacgctttcaccggctggcaccaaagcggcattaggtcttacacagtataccttaggagctgtggtcttcaccttaaaggcaattgtttgttctgagtcattcttgatggtaatatgctcagctgcttggctagtgaaaggtgctattacgaaaacagagaggtaaatcacattgaataatggaatcgcaaaaatgatcccattaaacattgaaataatgatttggaagcttgttagtatatcgaatgcataataacagaaacataatattgagtatctaagcatcggagaataattccatgtggttgaggatatggaacatctatcagaatccctgtaatccttctaagtattcatcccattatttgtctctcatgcaagaaaagtgagccaatatggccacacatttgaccacacgaagtacactttcaaatgctaaacaccatattttgtaactgatcatatagtaaagtggtttttaatccctttaaaccactgctcaaagcgacacatacgtttgtattccaatacacttggagtaatttcaaccattgtaaacttataatagtgagaaacagtttatacacacttgtgttagagctggaaaactaatagacttcccgaatctaacgaaataacaaatcccaaatagaaagataaacgaattagataaccgtacctgataatcttcgaacaattaacctaggaaccgatcactgtaaatcctgccaaaaactaagtctctctgttcttaattgtaatcgcttagttcaacttttctttgtttgcaaaatgtcaaattcgggtatttatgtgtgagggtaaccacaacaaatgaaatgggcactgaacctcgttacgtaattatcatgcagcgagcagtcgacacagacttccctctcactaagagcattaagcatcttttgaggtaccaacagtgcacggtttgatttcagttcttttatactttatattctatttaaacgaaactgaatttacctagatatgcatatgttgtagcgtttgttatgtattgactacgacaagtcttatggtatctttcaatagtcgtcaccacgagagacaatttccttcttgtgaggatgtaggataagggtgtgttcgaattgagccgtatatgagcccttaatatcgttcaatggtgggtagtcttctacaataccttgcctcaccaatgtgttcaaagcgtatacgtgcttgtcttcgcccaatctatccaagtaacgacgacagaacggtatagttccaaaattttcatcaataacctttaatagattcttggcactcgatagggatggtgttggatgtgaaccgggtttcttagcataatgagagcattctccctcttgtataacatacccacgaccggtactcccgaaagtttcgatagcgaaatgttcgttttcttccatctttgtgttgtcaccgttcttgacaattggcacagatttacccccatgaatcgaataaggattaatgttgtggccgcacaaattcctgcatggtttcacttggtgtgtctcaccgttaatttccacttcgtacgattccatcacttcttgaatagcttcaccgatatcagtcaacctaacgtcgatacctgcctctttaataccagtattggttgcatccttcacagcagccaacaaattatcgtattgtggatcgaatgcaatagtaaacgcagaatcgatgatataaccattaacatggacaccgaaatcaactttcattacatcctcgaacttcaacacggtcttgtcaccagcattaggagtgaaatgagcagcacagtggttgagcgatagaccagttgggaacgcaataccttggctctttggtctatcaacgtgatccccattggcatcagtgccagtaaactttctagtcccgtcttccaccaaattagcaatctcagtcaatgtcatacccggcttgatcttatttctaacactttcccttacacgacggtgaatctcagcacctttacgcatatcattacacctttgttcgtactcttcacttctttccaagtatctcctctcttcatcggtaactcttttcagattgaaatcttgatggtattccatccactgtccctcagggtatttctcatcagggtatattaaagcaatgttcttcatattattacccttcttcttcttcttcttcttctttttcttcttatcctgcacggtagcatcctctgtcacttcactgtcatcaacagctgcaggttcagaaacctcaggaagtgcatctacaacaatctctttgacatctgtatcagccaccattttttaaacaactagaattgatttctgcaatatgggtctttgcagaacttgtctgtataacatcggtcacctcatctctttatgaccagagtatacgtaccattgctttgttacctttatattctctcaagaatttcaatcttccaaagctttaaatttttcaacatgaaatttgacgaaatgaaataagataagaaaaaccaacatctgagcaggattccaaacttcaaaagaagccattctctgcactctttgaaccgacacttataacgggaaagtttactagaactaactgcttgtggtggatattttaaaatttaggtgaggtctaacgcgatcttatcgggctacgggacttaacattttgaaaggataggaaagcaaatcaaaccatgctaactgcaagagggttccaattgggtgccagcaggacatctactttattgtccagacaatttacacaatgcactattaggagacaagaaatcatagattatacaaggttgactccgctatctaaaagtgcaaaggaatcgtcaaacggatctaggaaagacatgtccttttcggcaatgatgcagtcgccaagagaagatactttgagttccaagctaacaggaatccaagctggaagaactattgatgtctttagcggtaacaccatggctgctttccaaaggctagggtccatcgtaagatcgaactccattcaaaaggacaagagggctcaaaggttctatttgaagcctggtaaggcaagagaattgagaaagtctcaaaagcacagaaaggagttcatgaagagtttcaagaacttaatagaggtggtcaaggacgccaagaggaagggttactaaatggctttatatggcttcttatgtagatacataaatcatgtcgaaacgaaatcatctctctccaacatgtatatagtttaacaaaagacagaaaacaaaaatatttcaaacaacagacattttttccaaataacatcagtgactgggttactgcggtgaagcttaaactgtatttcttatcttttgtacattatcttgcgtccttctttctatcgtctgcatgccataatatttgaaaaatcaatgattcttgcttgattcttaggaccatatatctttatgcaacacaaaataaggaagtacaggtagtttctcctactgacgagatagcaccttaaaattaactataacgtagtacaggatgtcatccagtgtacaatctggggtcatcacacttcttcatacggcatgcggggctggtatccttgcaatgccttatgcttttaaaccctttggattgattttgggtttgtcaatgattatattctgcggcttgtgttcctctacggggttatatttacaatcatacgtgtcgaaatacgttcctcctggacatgcctcgtttttcactctttgcagattaactcgtcctgaattgagcgtcgttttcgatgctgcaattgctgttaaatgttttggggtcggagtttcatatttggtggtcgttggagatttgttaccacagataatgtccacgtttacaacccatgggtggctcttatcacgccagtttcacatcactgcagttacgttgatcatcgtgacaccgttgtgtttcattaagaagttagactctttaaggtacacttcttccattgcaattacagcagttgggtacttatgcgtattagttgtcttccattttgccgttccaaatagcgaaatcgaccatttaagaggccatgttagcatctggaaacccagtgatgtggattcatccatgctaagcagttttccaattttcgttttcgcgtatacttgccatcacaacatgttttccatcatcaatgaacaatcagacaaatctttagacagtataacgaaattgattaggattgccattacgctagcaatgtctttgtacatttccattggagcgctaggttattgcaccttcggtgatcatattactggtaacattatcaccttatacccaaactccatttccagcaccatcggtagaatagctatagcattgttagtgatccttgccttcccgctacaatgtcatccagctagagcatctgtcaatcatatcttacattacttctccaaggggaacacccatcccccaatgacaaccacaagtgcagaacaaaacagtctattacgggactctgaactcgaatctagcgaacagttaacctacgaatgcgaagacgaattaattgaagaaaacagcgctaatcagcctccagtagtaacgttagaaggccctagattcatctttatcacgtctggaatcctattattttcgtacatcctcgctatgagtgttacgtcgctagcaaacgttttgtcaatagtaggagcaaccggatccacttctatatccttcatcttacctggaatatttggctacaagttaatcgcatcggagtacgccaaatccgttgtaccaccagcaaaagaacgaatcttgagaattatctcattgttacttgctatttggggattcatcgtcatgataacttcactaagtgctaccatatttctacatgcgacacattgagggtacaggataaacagggtactagagactaaccattgatactgctaccaattgtactcccgattgacactctaaataagcggcccgcgtattcctagcgagcctttggttgctgcctgtcacatgatcaaaaaataactcatctctcattgtagacagacaccaaaaaaaatgataaatgtataccgtatatacataaatataaaaagtaatcaatacgaacatacttgaacttgaagcaagtttatttcaattttagttgttgtgttgtcacaagtgttccaatagtccagcgaggcaagggaatatctgcaaacagagagatggcgttgattaaagcaagtcaagcccgtgctgtaagggagaatccgcatgtatctcatcaatttaacatctcgtcatttttgggcgatccttttgccataggcacacttagtattgcattgatctcatggatcattgcattggcgggatccattgctgttgcagcatctacgtctccattcccaagattttcttggtggactatagtttacgagatactactaatgattacgctttttatcgtgtactgtttggatttagttgactactatagaatgttcattacttgtgctgttggtatcgcattcgtatatacttcgaatagtactaacagtattgtgtactatgaagggtccaagagtggtgcagcagcagcaggatttatcttgttatccatgatcaatttggtgtgggtgatttattttggtggagataatgcatctccaaccaatagatggatcgattcgttctcactacgcggaattcgtccttcggtgctagagacatccatggctattgccagatcgcagagactgccggtcaaaccttcttacccataccaataccaggaagacttgcgttcagcatctctgcctgatgtccaccacgatgacgaaggtgagggccacagtggcaacatgtatgcgccagaacttcaatcgtctacaaagtatgtgtcgtctacagtgctgaacggatttgaaaatacagatcattcctcttcgaaaccaaaccttgatgttaatgcgcaaaatactgctacactgaatacacaggccactggcactttcatcacagataccaccaatgccaacacagatactaccatgggagacacattaggcctatacagtgacattggtgaagaattaaacagtttcccatacactgcagaggctttatatacctatcaagcggaccaaactgacgcgtatgaaatatccttcgaacagggcgaaattctcagggttggtgatatcgagggtagatggtggaaagccaagaagtcaaacggggaaacagggattatcccaagtaattacgttaagcttttggatgggaaatcacactgattttattactgcctcccatcagtttgtatcattaaacatttgatttgtgtatcgtcttttatattatattatttccacagtttgcaataacaaccggcttatcaaccttattcgcgaaaaattcaagtgcttttatcaacacagttactgaattcttcattaacacgcaaatacttgcttcgaatgaatcatgctatttaatgaatatgctattatttataattatactgcttgcaaatcgcttcaggtgctggtagtataataaagtcttcatctcgagtaagaacttcaaacacatcaatcttaataaaatggggaccatcccatgtaaattgtcgctaaattttgtttgtcagtagcactggacaaaagctcctgaacaattgcttcaacgctcaaaccgtctccatataacttactttcaactccctttagtgctcttatggattcatcattattattatcttcttctaaaagctcgctgaaatctgcatcggaaacactaatttcctcctcatcataatcaccagtaaactttgcttgcaatctttgcttcttcaagggagtcatcttccatgaatataatgggtcccatttcagaacatttagaacacataataatcgctctttctcgtcttgtaacaccttaaatactctttcgcagttatttctaaacaaaccttcgatacctgctacgccaaatccgtctacaatatcccttgttagtctaaagggaaccagttccggtattggcaatagctttccctgatcaaatgccactccaagatcaatatgaatgggttcaccggtttttatatcaatcaaaatattattaagatgcctgtctcccaagcctaacagatatccgacaatcgatgatgttaccacgctcttagtatatctgttcctactttcataccaatcatgtgcatgcacgaaagattgaaagaagaagcgtcttaactgaggcttaattttctccgtaattcgactgaatgtaagtactctttcctcaacactgtgattctgagcggctttcatcgtttttctagctttatcgaaactgatttcatcgttacaatgcaaattcaataaaatatcatgcaaagacatggaatttgcaacaaactcaatcaaccccgcgcgtggaccaagggggattacctcataggttctaacgcttaaattttgctttctagttgtcttattagcctttagtatcttgttcacttgtttgaaaacctgttccataattgcatcctgtctgaggtcatcattgctaccttttaaaagaacacgatgtctggtcccgtctgatactgtaaaagttgcaatttttggaagtgacagaccagatgaagaaatgagtactttgggatcaatacttgaaatatagctgcgtccctcacggcgtccatcctgtgagcatgtgattttgactggcagtgtaggcagaggtaaatgtactttcggtaaggtttctaaccagtactttccaatatttagtgtgtccagttgtaaaaacttcattttaggaggaattttatgacaagctaaagcaacagacatggaacaaaacgcttgaacaggacgagtaaattgtgaaccatatcggccactatcgtacatgtccagagcagcaattattttattaaccacttcaacccttgatttggttactgggtcaattactttggactccgaatcttgaaggctcatcgagatcaacggataaagagtttcgtacggcaacttatatagcattcgtttcagtgttaactgtaaggtgtcttgaaatggtgaaactgaatcagccagtttagaagccatttgactcacccaaggtaagaacttaaagcttggaactgtaccaatttccttttgtagtttagaatttataatgtcatcagtagaatacgaaaaccataggctgcaaaatttatcgacgacttcagcatctctagagttagagtgtaccaaagtcgttagaaagaagtgcagggcctgagatacaaacgcgattcttgaagaggatattttgttgtatctatctttgtcatgatggttttgcaaagataatctattatggtgtcttttggcctctttacgttccgcatcacgcagtttagggtttttgtaaatgctggaaatttcttggagctggttgcttgcctttgcaattttttgcttcaagtatagaagttccccttcatctaccttctgactttgtttatagcaaaactcagcatatgtataacatatagaagaccggaggttgggttcattaatgttcaagacgtcacgttcataatataaaatgtgatcattaaaaatgacatcaggactcctgtgcctagaaaaggatgaccattctactaattggctatcaacaacagcatccggcatcagaatatcctgaacatctgcaagacttacattctcgacattcaccgcagtaagatttgtttggagtaaatcttctaacatattgattgccattgcagattctttgttcgcccaaagcatcctggcagattcaacggttgatattcttttgcagaacaatgtaattgtgtcagagggaccaattgctggattatttgtaatatcgtcgacagctgcttcgagagtcattacaatattaatcaaatcttgaaatcttccttgatctctacaaaatgtagaggcatgaaccagatttaagatttttgccagctgaagagtgaaattagatcctggagcatgttcgatgacagaggtattattaatttttgactcgatgaaaaaatgcctactccaatgtaaaatatcgaaaacgttttcgggaagatagtctgcattaagggtgtcatggacacgtaaattgttcaatgttgtaagagtattcatatctgcggatcccaatttttttaatgaaacgagtagacctaaggattccatagtttcgaggtttagttgagaattcttaagtaaagatccaccgtccatcacctttaaaatgtgatcatcaaatgaaaaaaaatcagggatttcttttacatccttaagaatgctgaatgcagacttggcaaatgaatctcttgcttctggaattggcaaatcccatttatttagtttcagagcccatgaatattgatttgcagaaagcagtggattttcgaagttactatctagcatcgttgccaaacctgtaaagccattcgatgatgtgactgaagcaaactcatgcaagcatgaggagtccttatttcttagcccctcttcaaaccgaccattactcaatgcaaaattggtgtatgaattaaattttgttttagaaatcaaggtcagagaagatgctagtgaagatgataatggaagtccataaaagagatccttttcgtcaattttggaatatatttgatacagtaattcataatccaacatttttccagtgcagtattctccataaaattcttcatatatcatgagggaccaaatctctgatccgagagagagcataatgggtatcacaggctggagtttaattttgtcataaacataaagtgcattttgtacaccgttcaatgccattcctctaataatagagaatactttcgtgataacttccattttcaacgtacgatcctctgtcttaaaaatttcatctgctctattcaagatatcggagaggaaagagctgcgttgcttagggaaacttacaagcagtattttaattagctgtgatatgatagccgaatgaaggaacgcagtattatcacacagcaacgctaaaattctgaaagaagggaatttttcaacaatcacaagtaagatattgcatataaaggcggaaatccacttttgatagtgacaagatctgtcagtgaaagtcagggttaagaaggtttcacccagtttaatattgagcataccatgacagttctcaaatttttcccagcttatatcagttaagttttttaaattcaccaaggaagagtaactgtcagaactgatttctgctaggacagattcatcctgtaagataatcgactggatatgatcaagcagaaaacgcaggcttatatcgtctgctttctgatattgtacccataaaatttgcagtagaccagatataccagattccaagtcaagtgtggaacaatgatgtggaattatgtgatcgtaaggccttgtataaacaatttcacctagaatatttccaagccaccttctgaatttatcggaaactcttgcattatctcgcggtatagatatcaaattctgaatagtagtgggagagattaaatttgcgtcgaacgacccatcataatcaaaattatcaaataggtcagataaaagagagaccgaagttcggtcgacttcctggaatttgaagacttgtgcaatatcattccatccgaaagagtttgtttctagggttaataacgcataacaggtagcatacagctgtttgccatcagaaacacaaaagttgaacagaactggattcactttagggaataacgtttttttgacatttgaatcagttacagtaaagcagaatctcatgagttctgtcaatgatcgggcaacatccattttattgttcgcggaaaactcaagtaaatccaatatgaaaccatacacttctgaaaaaatgtcggcgttgaataaaaacttcgatagttccaacaggaaaaaatcgatatctttgaacaaagttagcttatgctcaaaaaataatactaataattttatttgccttaacacacgaattttttgatcaattagtacgcagttttgtaaatccataacaagtctttgtatcacatattcaaagcttcttccatcatcaatatcagtaaaaacattctttttcaacactttatagacaattggaaaggcaattgcaacattatcattcagctgcatacagttcgatgaattataatgcagcatgtttgtgaatcggctcgaattgaaaattttacaccaaaaggtcaacgaagtagcaaggttggagagatctgataacttgataaagtagtaaatgacgtcatccaaattaatagtgagaacgtttgggaattttcggcctaacaggtccgcggctatatcaaagatgaggtctttcacgcctgaatcaacatatgataaggcaatagtaggagctatgtatttagtaagaagcgcctcttgtttcaagttcagtaatttctttagatggtctataatgtaatagtaggttgatgattttgcgaagaaaaaactcgttagctccatttgatatctgatacaaaactcgtcaaactcaaactcaaaaagttccactttccatatgctcggttcatatatcttggatttggcagactttgtaaaccactggtctataataaaatatctgcattgatgaaagagatcttgtttagaacaaaggccataaaaagttgagatcgtatccaaacttttttcaacatataagagaagatgagagaagtttgtgttatctaacagatgtaagatagagttgagcaaataaaactcattgataagggataatttcgtacatgtcaacgaaaaaaatgcagcagtttcaaccgactcttgaggaggattgaatctctgaagtagttctttgaataatatacgttgattagtaacaccaacccttttgacataggttccgagcagagatactaccctgttcgtcaagtatttcggcaacctagtaatgcaaccactgagtatcttgaacactctttgtttgcctccagatatggaactattggagaggttgtacttttccaataaaagagtcataaaacgagcgagctcatataaagcttccacaccgctgaacgatgattcgtcatattgtgtcacaatccaatcaaaaatgtcattgcagtcggcagtcagaacttgacttcgatcttccataacccagtattttgatattccttcaagatatcttgtcagtaatttcattgaggtcgaagatgtgtcaaagcttggagctaatagtgaggaacccaagaattgagttagtctttcaaggctggcagttggaatttcattttcattgttttccagatatgtaatcaaattcggcaatgttctgttcagcattggcaatgataactttttcgaataaagaataaatgatgataaaggatcaaatgcttttgatactgaatgtacttgtagtgcgaactcaaaacctatttctatcatttcggaaatagggatgcttcctgcttcaggctttgcatggtgacttaaaaattcatcctgatgtgaagtctgctgagtatgttctgcaagcctctgcataaaggttgataaaactttctctgttggtaaaatatccataatgatgtgtcgaagtaaagaatctttgagtgaaatcatgccttccattaccgagaaaatctgagcgttctgaccaaaatcgataaccgaggatgataaaaggaatatctctttaaatcttgacaagtagtcggtgtagtttctttggccaacgagactttcgatggtacggagcacctggattgccctatcaatgaaagtagctgaaattgcactttcatcaattaaatcaaaaagtttgtacatgaacctcacacgttcggcttcttcgcagaaaacaggagcaaacttttgctttcgcagttcaatcgttctaattgttaaggagaagccagttatacttgccctttcctcagacaaacccatccatgtgtcatgaaataaagatggcctactatattcgaaagtggggaaagtagtatgcgtgcagccgcataaccaggatgcaaatacgtaaaagtgcgtttccgacacaaccagagtaaaaagctgatcccacctagcgtatagccaagaaaaaacgtacgtaatcggacttttaacggtctgaaaggtttttgcataatagtgaagatgcatccaaaatttgaaagattcattacaaactaatgcagggccatttacatcagataacaaatacagatctgacatttgctgtagcacactcttgtctttaattggttctaactgaaattcaattaatttgtagagtaaactacaagcagttttgcacccgttacttgttttcaaaaggggtacacacatcttaaacagtcgtatttcctcttccggactgaatgaatttttgctctgagagcacatcggaatgaaacaactgagacataataacatgaatctaacatcttgggagcaccgaaacaattcctctttcaaatgagacaactcaatgttactacagtcaaaaattgaaagataaagcaatccaatatgcaaaccggttgtcttgattttgatagaatcactatcaatgcaattacaaaggaaatcgtcgtatgtcaatgaatcctttaacatatgggcgaatgtatcctttacttttcttctcttaaaaagtagtgaacctccggctaaagaactctctttatattctaggaattggtaattagctttcagcatcattgtcagagacagagcataaagccatatatcttctagacaattcttttcattctggcaaatatcagaaaagctataccaattgaattttgaagatgcaggaccatctatgaaggtaacacagtctagtgtgaactttgtatgatcgtattgtttcaacgaatgaatcaaatagtcttgaagcgcagggagcaatttctctttgttaacatatgactgatccttgtcctcgcctacaattatcggagttttattgtacagcacttctgatatcatcaaattgaatctcgcgatctcccctatattattttcattggttaatttaattcttagtagatgcttaattgtgtaatagctaagatttatcacgtcctgaaatcttatcagatgtagtcttaatatagctgaattgaccaatgttagtatggttcttgtattagtgttttcctttgttatcaaagtaagatatttgattgtcattcttacgacaggagtagcaatgtcctcaattcctattgtgtcgatttgaaagagctctagtaatgtttggagaaggttcgctattattttatcattatatgaaacatcaagatggtatgttactgcatcgctgatatcatgggaaagtgaaatccattggtgcaattcaaaattgcattgaaaaacaggggaaccacatagagccacaagagagtaagttaggtgatctgccacggatgtgatcagtgatcttgaacgtggtctagtcatcaattcaaataacgtcatagataacagtttgatatgtttaggtttgaatctttcacaatttctttccacaaacaaccttaaagtgtaagcggcagagcccaatctgttctcgtatagttctatcctagcatccttgccattctctaatctggttttttcatatctagtcttttcggactctataatggttataatagcatccaatatgggagagaacgctttcacgggaacctcagttggtgaggttttcaacagtaaatttagattatcgagagaatcattacgagtcttcaattttagagatgacagtcctgttacgatgacagacacctcaaagctaaagctcattagttatgtaacgaagacatttgttgcagtttatcttcaatataacgttcggttctctctttctatagacagacgtttatctttgatatttctttatttacattatttgcattatttcatgcaaatgtaaagttaggaaaaactgtaaatagacgtggtaatgagatatctcacagttaaaaccgtattgaaatgcagaagctttgagaatacctttaactaatactccagatttattcgatctaaatattgtttaaatttacacatataatgactattattttttaagtaaagttggatagggttaatttaaacaacaacaccagagttggaagcaattcttggccacaagtcggcacattccttaccgactggaccagtaacagcggaacccttcatttcacccttagggttagcaatgacaccggcattgtcttcgaagtacaagaagacaccgtcctttcttctccaagccttggattgtctgacaacgatagctggcataaccttctttctcaattcaggcttacccttcttgacagtagccataaccatatcacctagagatgcagctggcaatctgttcaatcttgaaccagaacccttgacggccatgatgtacaagtttctagcaccagaattgtcagcacaattcataatggcaccagttggtagacctaactgttaaaataaaattgacaacacccattccttaagaatgaatgtattcataaaatttgttagtaaaatagttcatatatttgaattcaaactgcgagggacatcacatcgagactagtcatcaagttcttttgcacctcataatatcaattatttggtaacacagttgattcatgaaaataaaagcacttaaacctgatagtgttgaaagttgaaagtttcaggatcatttagctaaacgtcgttgatggtatagttgcatgttcagtatatcgcgagtcggtttttttcttcattttcttggggttacatattcccattcagttttgactattcttcactcgagttggatgggtcacatattttcaagactctattctaacacccgacctaatctgtctctcatgacgttttattcgtgttatgattcgctaatctctctggtatcccgcctatctgcttcgcttttgagtttgcttattcgttcaaataaaacgtttctaacatacagaaattctgaatttagtaccttgagcaccgttacctgacatctttgttgtttattggtgtggattggttaatgagttagaatctgaaataaagcagaacgtacacaaatcaagcctttgttaataactatcttactccatcgaattcaaccaatggcttgaaaattatcaaaacctgtaatctgatattctcaccagtccataatgacaaactcaaggagctttcaattctggatagctctgtactgtgtttctgtgggagcaaaaaaataagcccaatgctgcctaaaacggcaatcgtgttagtatttttaaaagaaataggaatacaatgtgcgtggggaggtgtatgggttcgttgccatatggtgtactggtgtatgggtccgaatgaaaaaggaaagagttaggacagtcacacctatggtttccctctgtgttcaatataagcaatcaagaaccaaaatattccattgaggttagagacatttggaatcatacacatcaaaaattcagctaccaaagacttaaaatcattagacgaatgatccaacgggtttctgaagtatagaaaattctatcatactataaatttggccatatctcactaccactggtatactcagtgcctttttttttaagtttaaatccatacttctgatacttttttactctttacctgaagagagtcatcggcgtattaataagggtagttaatgtccagactgtattaagtgttcttacaaataaatcaacttggaatggtgaatgaagatgacagtcttcgggtagttagttcttctgatactacggatcagttacagctggtacctggtctttctatgggacagagcactgtccgcactggtgaggatgaggatgaacgaatagttacagggcgcaggcgccacgaattgcaagagtccgaaactgatatcgaagaagaagaagaagaactacgaaggaagtcgagacgaataagtcggacgtccatcgtaagtattgatgatgcagacatactttcagaaacacaacatgtcactgaaataggcgacactacagagcagagcaatctcgccaccgcaccgccccaagaggtatctgataatgaagagcctgcaatcatttctactgcagattatggagtggcgtaccaaaatgtgcaagaccaatcagcagaagcacaagaccaagaagaagaagaagaagaagaagaactgcacgaggccgttggagaaggcgatgacgatgacatcaaagtactcacggaagaggaacagattaaagcacagcaggttattgagatagatgatgaagacgagactgaaggccacaagtctggtaaggatatgtcagagacacccttagagacgaaaaaagcggctgattacgtctgtcccatttgcatggaacctccagaagcggctttagtaaccaagtgcggacatgttttttgcactacatgtctgtacggtatggtgaatagttccaaaggtaacggtagacggaacggtttatgtgccttgtgcagagaaaacgtcaaactccaagatcttagattaatcgtcatgaggaaaaaccggatccgaaaaccaaactaataaatacctaatgagactatacataggagcaatgaatttacataatactgtcgctgttgcaatttttcagcctttcaactttttaagcgatgacagtcacaaaaaaatcatcagacataaatgcacttcaatcaaggtacctctcaatggcagtagaacaatggagtgtgtgtataaaaaaggagacagaaccttaacagtataccctttttttcccaagaaataacccttcgttatagccatatatatatttatttatttatttattatgatatttcgaatttcactccccatatctaaaactcttatgacttataactatactgcaacttcgaacgactccaaatgcagatcaaatgaaaacaagactgagaatcaaatacctgtcaacaccgaggaaactggacttaaaacaaaacagaaacagcactacaaccacctccaggaatacgaaaactactgttacaagaaaaaaccagcgtcatattatctttggtccaaaagctaccgagtacggcacaaaccattaagattggataggttcccaaaaaatgaattgaagaaaatccgctgcggtatattcattggacatcaagaccatcgatgtgcatattgtccgttccacgggattaaacatggctacactttacaaccaacattgaattgcatttgtcgcttcaaatcggttgcaccaagtccattgaagcatgatataactaaatacatgattatgaaaagacatccagtctttgataacaaacatgtatactggaacaccggaagtaaacagatagacagaattataaaccacatgtgtatgaactcaaccaacaaaaggaattgaaataattagtagtaatgggacattatactgcatttcttccaataaggcaagacaaaacaactagacagtatataatacagtagtacgcagtgcactgtcgactgtatattgacttatatttacttatcatgtttctcctttccgtcactgaagaagacacttaaacctctcttctattctgaatcgtatcatataccgccatctgctggagaaaaggggaatatctagcagaattaggtaaaaagtcttgtaaaaacggccagtacgaaaaactctaactggaaccggattttcgaaggtgattttcaaaaaaccctagaacaagcagtttgaaggtaaatctcaatgacagccagatggctccatactcacggggcatagcttattgcagtcaggatatgtctggttccgcggacaattagtcgatgggagaaatacccttgtgttcgtactaaaatgcagggtcgctcggcctttgatgactttgctgacagtaattgcctgtggtgttagggtttggtttgttctttataacagtcattcgagtgttagaaatcagtatctactgcaattacgaagtgtaagttgaattgctaaagttctactaacatattgttagctctaagacaaaaacatatgtgtacccgaagtgtggttaaacgtttatttttgaagcatatatatattcatattcttgaacgtatacgtattttggtagatacaagtcaatggccggtgttgtgtagattgctgctaagaaacaagaattaggctgctacagaagctcatcaagacaaaagttcaatttgtataatgaagggcgaagatgattatgcccaaacgacaagaaaatctgtccaggtggaagattttgagttaaatgacttcgatgatagcacagcattccctttgatcaactcaactttaccgaaaggtggcgatgatatccatacagagcaagcttttgaaattgatgaatccggtagtgagttgctgcgcaagacatggtacgaaggcgaagaagttgtgctatatcctgccaattatgaaaaggtgtcagtcgtccgcctacaaatcgcgacatgtttggtattattcgtgatgtttggtatgacggatcaagtgaatggatctttgatgcctgttattactaagtattacaatgtcaccgagcttcaaatgtcgatagtgtttttccttcaattgatgggctatgtgtcggcatcggtcttaaatgatattttgcataaaaaatgggggtctcgaggcgtaatgacagcatcatgtatacttgctgcatttacctacttggttcttgccctaaaaccatattcgctctatctttatgcgatatgcttctttccgctaggtatgtgtgttgggtttgttgactctacaggtaatttctactttggtaatttagagactagaaagaatgaatggatgggtttgcttcatggaatatacgggttggccgctggtgtaaccccaccattagttacaaccttcgatcattatttggattggtcttatatcttttgggtccctttggtgtttgctcttgtggggttggcactctgcatgggggcctttaaatacgaaactgctaccaaatacagatacatctgtgtaggagtccccgatgaatcaggtggtattgaaaatgaggaagagataaaatggtaccagttatcgaagtatcctccgatgattttcttgtatgcatttttcttattcttgtacttaggtacagaaattggtgttgggacatggctattcacatatttgttgaattataagaaaggtgagaagttccttatgtcatttgttactgcgtcattctggtctgggatcactatcggtagattaggtcttggttttgttacaaaaaggttcaaaaatgaatacaggtcaagcgtttggtacggtttgacttgttcattgttttttttcctattcgttatcatcaatctaatcaattccacatcgacattctatttctttgttttatcgttgatgatctttggcgctggtatcttcataggtcccttgttccctaacgcaagtgttgttgcaatccaaatcctaccgaaacatcaacaagttagtggtattggtacagcaatcgctttcggagggtgtggtggtgcattaataacatactcttttgggtttgcaaacaagatttttgggttccaatactatccatttctatgcttccttggttctttggcattcaacatagtttggatgctctacccgaaaattatcaaaggacatagagagtacttataaattactcaagctcaacagatatgaatatcgtgccgcgcatggaaattatttacttatatataataggggaatcgctcctacttcttaacggacatatgtattttaaatccatactacagaagtaattgaatcagcttcattcttatgcttaaggtctgctgcacgtgatctatttttttttctttacttgaagcaacttcaacatcgagctggcatcaaaaactaccgaaatcagaatattacttgcatttaatgatattgagaggtaggaaatgcataaaacatgtatcaaaagacacggccaacgtttcacattacgaaacttaggtgaactactattcatactgttctcagaaatttcaacacagcctggtctcagcttgaaaaagacatagcatggatcctaataccgagggcaccacaactaaaaagtatacatcgcaaagacgaacaattgacatttctgcatcttatgatagactatatttcttgaagaagcatggccaggagaattcgtcatatatagaggcagaaacctcatataatgctcatatactaccgccagatgcctatggttttcatgggcatgccatcaatacagcaaccaaatttacgcatctttcatcaaataaggtaaagcacgttattccggctcttacgtggacgccagaaggaagaaggttagtggtagctacatacaatggagagttttcattatggagtggatccagtttcaatttcgaaagtattatgcaggctcatgatagtgcagtaaccgtgatgacatactcacatacaggggattggatggttagtggtagcgctgatggggagcttaagatctggcaaccaaactttaatatggttaaagtcatggaccaagcacatatggaatgtgtaagggaaatatcgtttagtccgaccgaccagaagtttgtcagttgttctgatgataatgtgttgaaaatatggaactttagcaacggacaacaagaaagggtgctatcaggccatcattgggacgtcaaatcatgcgactggcatccgaagatgggtttaatcgtatcaggatccaaagacaatcttatcaaattctgggatccgcgtagtggtagctgcgtatccaccatgcttggttttaaacatactatcatctcgacgaaattccaacccaaacagggaaacttactatctgtaatttcgaaggataaaacatgcaaggtatatgatatacgacaacaggctaaagagcttttcagtgttcgtgatgatgtcgactacatgacattacagtggcatccaatcgatgaaacagtgtttaccgttggatgctatgatggatctataaaacatttcgatctatcccaggaaaatcagccaaacaaacctacacacaacattccatatgcacatgaaaaatgtgttacatcattagcatatagtccaattggtcacatcatggctagcgcctcgaaagataggactattcgattctggacgagatcgagagcagtcgatccaaacgcctttgatgatccaacatataacaatgaaaaagttaatgcttggtacttcggtatcaataataacattaatgctgtcagaaacaaaacagaacacggtgttgctttgccaccaagtgaagactccaataataatgaaaatggcgacggttccagatcagttgaacctgagcgaccatctgtcagtactttaccaggtttgggatcaggattaccaggcctaagtttttaagacaattgaaagtcatggaaattatagcatcaatattatttaagcagattaaatgtaaatctaccttttcttcatcattaataagtagactgtatcgattgaataaactaaaatagaggttaacgagtaaaatactatactaaataggtaaaaaaagaatcagtagttgttgaatatataaaagtgttaaaaagaaccgagaaataaaaacaaaaaagtgttaggaggtcgttacaattccagtcgcttaatcaactggcggtcaaaaggtcattaaatttataagatatcatttcgtcattaatattttttttataattggtgtatcaattggcaaggagcactggcattcaaactctaataaatatagccaaatcatatggtataagagattacaacgtttgtagataagtatcattgatactttcgtgcaacgtcattatattggattttcggacattttcatctatggcatcagatctatcacgggaagaggatggttgaggagaagtaggggacgatgtcccatacttcaaaaattcgttagccttttcgatgtatccgtatccgtacattttagaataattctccatgaaatattccattgtattgataagttctgctgtatcggaacagtattgcgaggggaagtagtacatattactatcgtctgcagaaaattgtcctgcgttcatgatatggaaaaagaataaaccgaaatttggattgtgagaaccttcgttcactcttgcattttctttgcaatagtggtcgaattcgcttctgctgaattgaacaaactgcgaatgatactgttgtaatctttttgcgaaatctttcacagcaaattcgtaaggcttatcgtaataatcctgattaaaagtcttattgtgtatgttgtatttgatgaagttgggatcagtgcaggagacttgcaaaaagataggtgttatatgaatcgcatcagcacgatcgtcggcctcatcttcatattcatcttcatctatatcatccccacgtgcgcggttcttattgttgcttcttcttgcattatgtttatcgtattgggccttattgaaggatctaatctcctgcaacacgtaatttcttctttgcaaagtcgagttggtggcgtcgaatatagccaaatcacatctatcttgtttcaaatcattcaaaagcttagaaagggctattcttgcatattcctctttcttatgcgagttctttggattgaaaacgtcctcctccgacttgttcaactcaggcgccatgaacggcgagacctgacggcgggtgctcaacttacgtctcacgttaccggcattgaagatagagcatcgaagatgcgctgtactacgagacgagtgaaggaaattgatcaaatgtctggatatggtagactttccagtggctggtaaaccgatgagaatcacgcaaaatttatggtttaaattctgcctcttgttcccaaactgtatagtcaacgaacttccctgagacaaataagaattgttagcagcatggttcgccgacgatgagccttgtaatccggcaaagtacccatctgtatggttactcacatctatctctgtttctgtatgtgaaatcgtcggataaattgacgatgagcttgagccatgtagtgaaaataaagaattcgtggaagtattggtagaaaccgtcctcgagttcaagtgtttcctcgactctagacttcttaataactcgggccttagattttcgttgggtcgcgacatccttgattggtgtgtatgtctcgtcgaattgtgcttgcgagcttgctgtttgcttctgtgcttcttcacctttcaacttttaacgggttaattctttacgtggtcgatctgaaaaacactagagcttaaatgtgtatcgaaaactggcataagttgatccgaaacactctcaaaagaaaagattcaacagatattcttgaaatcgaaaagaaagaagaaaaaaaaaagaagcgaagatagcgtagattgcagagcgaaatgctagagacagaaagggtagagaaaacgatagtatacccgaattgtgacgacacgttgtcaggttatgtttgtccctttggttacaagtaggaaagatgcccccaggtaacagttcagtgtgtcaacccttggtttgtccctcactatatatattatataggtgtaaactattcacgcattgctatactagcccaagtcaggcaccacgcggtgcgctctcctccattacaggaattatagcttactttggcaattcaattcctgttaggctttaaaaaagagagcatgttgccgaaaagaaggctgacatattgacaataaaatggatcagtcctgggatctgtcacgtttattacggtaaactaacccagctgcccgttacagctccgatttaatcggtgtaacggtttcctctcgaggaaaccggtgtgagagaggtactgacgacagtttcgcgcgctattctgttgtgtgtctttcggataatctgcctggcggttttttctatttgccctctgcccgccgttcccctcttctgtctctctttggtctctttttcatgcctggtcatttgttctcctctttgcccgtttaggccctacactctctgcacgagttattccgatcgctaattctttttttgggtcttttttataatgcgtagtgtggtgtaagggaattgtaggatttcttcctgtggaattagtttctccgatccgccatacctgaaatcgaagagaaatcggcaattctaccccattctgggaagacaaaagaaaaaggacttcgcgagtcatgtagagcacgtgacttgtattttaaacttactaggtcttcgttacataatcagcgtcagagagttggtattaggacttttagaaataatgagcattagcttcgtccgacatcttgctattaaatttgtcttccccctttgcttgcattgggagaaagtttgctgattttcttattctgtataccttattcggcggctaaatttcgaattaaatctctcaagcagccgaacttatgaaagtttaattaaacatcttgataccaaagtcttcgtttttagagatcgccttaacaactggtatgctgggatatatatcacagttgagccagcttggattccacttcatcacagactttattgatgtgttccatttccttgcgtttatgttccaattgttcttcaaataacatgattagcgattcacgactttggtgcggtctatattcgttaagaagatggtgaatattgatggctatcacccttatctcgtcaagttttttctcatatctacttgaatccactcccaatattcctataagctctaggaaatttagtaatagtgatttcattagttttttcgactcttggatcttgttctcgtaatttgtcccactttgcgaatcttgaggactaggttcaacttctgttgtggtcccgttttccaattccgtgacagattcccgtttcctatataattgttcaattcccatctgtgataactccggtagttcatccttaattttccatacattaccaaatgctctgtatgaaccatccctgggtagttctggcttcacaaaatatttcaactgctccctctgttttgttgtacatttcgctagtttttcttcatctttgccacattctctaaatagttttgagttctcttcggtgaaaaattgaatgaacggtggtggtggaggatacaatgatgatacttcgttcttgtcactcatggtcctttatattttagcttctgactggcagtattgtctctcactttcacaatcactttcaaaaaaatcttttattgagagggatttcaatactttaaaggacggtcgaggttccagtttatcttgaatctggacagattatggccacggaggtctaacacaggtctgatatcgccaacacgctttcctgtgttcactgatttatcacttgtttctgtttgtgctggttactataagttggatttccatttcatgtacaatttcacatccgggtaacaaatgtttgtattcacgtgatatgaatatcactcttgtctctctttcaacatgaattctaatgtttctgaacgtttgggcagttacgaaagtccatagatcccattatagtccacagggtatatcttttgtcattcataagactactctattcgatcattaatagtttaaaaaaaggttttcacacccgcgtttccaaggattgaacgacagttagacctgggacttagaacgtctgtttgtaatctgttttaaagaaggaaggatttatatttaccaatagtagctgatcgttaggagatggccacggatttgggaccaatagaggcacagagcgggacagagggtgctactgagtcaaagcccaattttgagataacgaaatggacagcggtagctttttggtcatgggatattgacgttgataattgtgccatttgcagaaatcatattatggaaccatgtgtaaattgtcagcaggaagcaactttcaactcggagcatgaatgtgtagccgcctggggtgagtgcaaccacgcattccacctacattgtattacccaatggatcaagagcagaaatgtttgtccgttggataataaaccttggaaattggctcggtgtggcaagtgaagatagagtgttaagcctacaaagatgcattatcgaaatttaatatcgctattggactgttcgaaccgcaaaaaatgttactcaatttagatttccaatgatttaataccaagcggatagtgtggatttaatatctaccattgggaagaagcttagataatctggcttctgtgtatatatagttacgtaacgagcttctaatggaattatcgacaggttcgatcggtcccaaaacaatagacaggacagcgttgttccatgaatacaactaggatgcgtacattcctcttcgattgcttcgtttttaagatcagtatttgcattttgtttctaaacataatgcatatatcatgggatttggtaatacagtgcgtttcggtagaatttaccccagtgaatccattttgcgcagttttcgtcaaaccttttcgccagaagttcgtaatcagtaccgtaattgccataaaactcaataaagaagcaatattgccattttctttctgattgcacttgattatggaatggtctcgaactgattgagcacatattcaacttatactccctcaagacatttaatacatctattaaggaacctggatcatcttgatttatcacgaaggtgacaaagtttactttcatttcatcgcctttaggtgggagagcttggctgccaatttcgctagattcgtcacgccttttcaagatcaagaaccttgtcgtatttccattgacatcattgataccgccttccacaatcgtagctttatttagtgatgcactcgcacggcttccaattgctagagttatttttctatcagtggcatattcagctatgcatctttccacagcccccgcagtcgaactgcagtcgatcttggcggtcttaccgtattttgtttcaagatcactgagatagtcttttacttggccccaaacttgtggatgtgaatatataacatcaacctttcttaattgttcttctgagagcggtactggtgaaatcaagcaatgggcaatgtcgacgtattgttcaccaacaacctcaacacttggacttaaatctgcttgcataaaatctctgaaaagatcgtacgtgaaaacaacttgaccgttggtggagttttcgagaggaactaccccgtagtccatatctatgtctgaaatgagcttttcgaaacatgcagggatagatgtcaccggtattagctcctcgtttggaaattgttggagtgctgcttgatgtgaatatgttcccacagggcccaagaacaatactttcgccattataaatgtagtagaagtaaaacaaggagatattccaacttccagcaaacagtgtacaatgtgcaactactgtcggggctttgtactgtttgagcagaacgaattcaatcgattctactcataggttgggtcatcgatgcatccatatgctcgtagcacttctggaccacacttagtcatagtggtgaaattcattttgatgaagtacacgtgactaagaagaaagccattccaacgcatgctgcccaacctcgaaccacagcctgctgctactcaaaaccgcatgctgttagcatagatcgagtatgatggaatgttttctttatacaagcgacatgtatatatatatgtatataaatatatataaatgtattaggaatcttccactactccataacttgagaaagagcaactaatagatcaacattgaagtttggagatccgttggtaaaatccttcaaaagttggaccctcttttgggcaaacccggagtcttgtcccatagcaccatagaatctttgaacgttcaaaagcaatagttgagattctggtagggaaacattagaatcagattcaacttggccgttcatcaatacaatgttcttttccttggccaaatccaagtggaactgtagagtagtatgaggtcttgcaaattctttgtgcaatttatactctgctagagtagtcataatacagtggacggttttaggtcctacaaattgccactgaatgtaatgcatttccatggccggttcttgtttctctgcagattcagcagcagtttcttcaactgcacgctctcttggcaaagggataacgaagaatgggttttctttggctaaggcactgatcttttcccagatatcgattggaacaacagcgttcaatacattgtccttattggcccatctggctctccaaagaaattcgcattcttgtttagagaggtttttcactttttccacatccaaaaagctgtccaaagtcttaaacggctgttttggcatagatggatcaatcggaccacgggacttagcaatgttagatgacattttggttctttgttcgtagtcttccaattctttcagtggatcaattctgtttaactcgagtttcttcttttcaatttcttctttcaaagaattcttaagttcctcaatgctattaaaaccttgttcgcgagccttgtccaaaagcttgtccttgtactgttgttctaatgaatcagtagagtaactagagtttgattggattgatgacgcaccaataatacgtttgaattgcgtagcagatagttgcgaggccgatcttttaacaacacgggtccagctttttatcatgtgtccgaaaaattacctggatagattcacaagttgtgttgataggtatcctctttcaactagtgaacttactctctacagtaacctatttccagtgaattcttccgtatctcattaaagttggtaatagtaactttgttccaatatcacttttcataacttttaaagaaaaaggtaaattctaatcagcgtataccggttcagataagatacatgcaagaagaaattgagaggatgagaaatatgagttaggtgtgacttgaaacagtatattgtcacactgaattgcggtgtgaagttatcacaccttgatacttcccttttctgctactttttaatatcgaaatctaacctacatgtcacacatatattcgcattctaatttggatgaactcttggtgtctcttttgggagaatacaagccacatcttcaaacacatagccataggatgaaatcatggaacactttgctcaaggagtttaataggcgatctggattaaattacaggcaaactaggacattgaaaaggaggtttgataagctttgttctgtttatcttaaatatggtagcgtgaaggtaacgaatttcgaaaccttcaaacagttggtatttgaattcgagcatgaacgtcaaaaatctgatagtactgccactgaatcaagtaacgctctaagcatgctggcgcgaagattggcggagaccggagaactggtcaattcgaactcagacattggtgacgatgatgtgttggaggatgatttggaagaggaaaggcggtatggcgatgaagctgacgttgataatggaccgcagcctatttcagtacctagtacagctaacttagaaccagcagaaataattttggatgataatgatgatgatcgaacacctcttgattccataacgatattaccacatactcaaatgaaccgccttagacaccaacaattacaggaaagccagcagctcagcgaaacaatacgagataatgtgtctaactctggtagtgcacaatttgccaatacgccgaatctggtggaacggaacaacaccgaattgagcctgcagcagcagatctttgatttaaagaatagctttgacgaatataaacgaagagaacaagaaacgacacggcaattaatgtacaaattggattatatagtttcactgttgaaaaaatgatgaagtcattcaacgcattatagggttgattttaaatccataagacgatcccaaccgtcagagtcctcccagtaatttttacctcgactcattaaagtcttgatggacgaacgagccttatacctccaattttggcatacgacgtctcctgccccatgctttccttccatttcaccaagtgattcatatgctgcaacaaggtcatcgcatacgtcaacactctcattccagactttctcatctatggtcaaatcaggattgtgggaaatggctctgaatgctttttcgtgacaagctaacgccatccaaggtcttcttctccatagttcgaccttagcaacaagtttccaaagtctcacggaagttgttactaaagaaggcaaaatatcacagacaaactccaaacaagattgttgatagtgagttaatctttgtgatgagtcggttgggtaatcagtggcaactaaaatctcaatgagtttttccaaaataggtagctcaatgctcatctcaccatttttgtcctttcttaagtcaacaagatttctaaacgcaagtaacacatcttcccattcaccaagtttcatagagacgatcatataattatcccagattctccaattcttacgagcatcggaagaaatggcgcgcttcaaacaactatgagcctcctttaatttatcgagctgcacataagctgcgctcaaatttgaccacgataacgaatgcgtttcgtcaagagccacacatcttgaaaaagcttctgctgccaaattcattttaccacattcaagaccaatgcaaccatagaagtaccatgtgtcgaaacttagtggggatattcttagtgaatcattcaaatgcttcaaagctgctgtatagtcccgttccaagccagagcccttgggggggttatagtaataccttccgagtgagttctttgcattcacgtatttcccaatttcccaacttttttcccatagacttggatcttgcctaatgtcacctagaatggagtaagcacgagcatctttagggtttctctcaatacaatttaccaggatttgttcagcttgtttttcatcacccacggctgcatagcataatgcggcttcgcatgccatatgcaatctctcgtatatttcaaccgctgatcttagaatacctagagacatgtatttttcggctaacgtagcatcaagagaccaacgtgggattagtggtaactggtgtatgtatttcaatcgttgcttggtagattccacgtcactggctctatctggtatcattttagtggtaattcgtaaacccaattcctcaaccaatgattgcatttgcaacaaacctctttccacagttttagctcttttagtttctacgatcgatctttcccataaggcacgtgaaaaaactgtccagtttttggcaccgtcttgatataggactctcgctattaatgcactgagctcttcttccgttaaagggttgttggcgggcgatgtctgtcttattgtgtatagtctgagaagtaattgaatattatcatattgactcaaagcaggttgattattcggatcaagctcttgcaaagattgcggaatgaactcctgtctgattgcaacagggagaattttgtcttcaaggaatccatttgtgtcgttcaacttttgctttttcactatctgttcatctatatgttcatcaccaatggcttcaaaatgtggtttctctaatagtagatccgagtccaattcaaaagtatctggagactcagcctctgtaaacctttcgttgtttgagtgagactttgctagaataataagtcctgaatgagcaatctgttgaaacttggtgcgtttggcttttgcaccagttaagacgaattcgaagtcggtcaattttttcaccttagttaaggatggtagacataaatgttcagtctggactgcaagaagacatctacaattttccaaatagtatatgatgtatagttgttttctgaacgtttcgtcaatttcacttggtaaagcttgtgtgatggcatgcgccaaatcgattgaagtcaaaattgatgaggcaatgattggatgatggccatttggttccgccacaagggatagctgtaccaaaatagctcttgatctccaccagtaagctagtgccgtagtagggtccatatctttggaaatggccacctgaccatcgtcatacgaatccaggccaaataaagtcttcccatctgttaattcttccaacaaaatcaatgccaaaatcaaatagacgggatcatcgcatagctcgtaggcagtttggcctgaaacattcaacagctctgaaaagattgaattcttagattcgtcaatctgaccctggttgaataacgtcgcataagatgaggttggtgtagcctgtcctgtaaagttattctggataaagcactgtaaaaaagcaatggcaacgacaagtgattcggaagaagagtgactcgatagaacattttcatgtgcccattgttttagaacatcaatatcactagatttctcgattagtttactgtcaataccttttttgatagatttgttaattacttcatgactgttacctgatagaatctgagacgccgcccaacataatggatgatccgacaacgattcaactacagagggttctgaggccagaagtaaatggctatgtagtagaacatccatgtgtataattcctctgaaagctgaccagtggtttcagtgttacaagatttataagcgatactaatccattagctttctaatctcatcgtttctcgaacgatctcatcggttaaaactgtcaaaactttttttttagctttctttcatgatacagagcaatgcagaacagaaagacaaattatgcacgtgatttaaactaacgtcgaatatctacattataaactgataaattttggtccattgaaaactacttcacaagtggagttcagcctaataaagttgagtgattatctccgataatattctagtagattattcatatcttcccattttgttggtggagaaactgagcatcgacttattggatttagtcggttgattaaattggggattcttcaatgatctactcttgaagtttataatagatttggtaccagacgttgccgcctcgttcaatgtggttggggggtttattctggaaagccagtacgacgagaatactagggatcccgctgcgaacaaaaatatgaaacccaagataccgaaaaaccagccgaaagtaccttcaccatcaggttgaccagggacacgaacattcataccaaataaaccggtgataacattgaggggaacaagcatggtaccgatcatggtaaccttacccaacatttctgtgactttattgttagaattgaaagattccacttgaagctgtgccaagtaattggcatgggatctggaaaagatcttttcataagatgacaaattttggaacatggtaacgatatgatcttgaatatcaccaaggtacattgcaatatcggctctaggttgttgtcttttttcgatagaaggagcgctgtctgggggcatcttgaattgaaggtttgcaatattcacttgagaagttaacgcagggccgatgccattgatatcgtcctggcatcttttggcaaacattttgataacatctgctttaccgctgagtaatctcattagtgtcattgttttccttcttccttcaccaattctctgaagcattacagcgaaattcatgtctctggtcataaacactgaatcttctattgcatctgcttcatattcgattgattgaataacaggtgcaaaactatctgtgatatcatctactaaggcgtaacatatccaatctgagtttacgccgacataatctctaagttgtctcacacgtcttctgacattggcacaatgtgagattgggttaaagtggaaagttagaataccgttcgcaaaaacaaccatatagacgttaatgggctctaaaaagtcctccgattccatatcattttcgaacgtatggaaacagatgaaataatagtttttgaaaagttccactttttcacgagtttcttgcattctgatatcttctgatgtcaagggatgaattccaaatgttttggtcaagcacctcatttcctcatctgtagggcaactgcagtccaaccaccaggtaggagcaccatcattgaataattgtctaaatgattgataaggcttcactagtgacgagaggtctggagcatgcaaagtttcagatacgtcagaactaaaataggcaaatctattgggtgcatcaaatggagttgtctgttctggtattggaggaaccgtagaagtgtaatttgagttcatctttttgatatcatcttcgtcatactcatccggctcaactttattattaccgaaagagatcccttgggcaacagcttctggtctaggagtatacttgagagctgcggatgatgaagaggtggacgaatctgttgaagatggtggtttacctgaatgttgaccaaaagtattctgagtcgtcacagcagggtgggaatatagatggctgttgtttatggctttttcttgtgccgtaaattcttctaattcatcgaaatcaataccgttaatgcgtgtatgttcccttttttgaatagggaaacacacatcttcttccgtctcttgagacaggtgtgacacttgtgaattatcactatcgatggaggcatttcttgtaagacgacgtctcagttctctcgatttttgagagctctgagacttagaggagactgttcttgttagagggttccctttgatggaagtattggatgaagatctcgatttcttcttgatcaatggaatacctaatgaatgcgacccgcgtcttgaatgaggttgagagccatcagaataggatttgctataatgtgcggcagaatgggaaccaggcactttcagcttcccaagcttgcttgagtttgaaggaccgataggaacatacgtattggagccagggtttggaaggctaagatcatcatcggaatcaccatcaaagtttataccagatactccagttaatcctgctgctccttcgcgggaacctgagcccgtaactcctagtgaattcgagtacgatcccaagtttggaccctgcatgggattacgcgcagctgcagccggtgcagccggcccaggattatgagaaacgtagtcatgttgctgtctatgatcatacaacttagtatgctcttcagttttcaatgacgccaaagaatgtgctgctgaagtagtacgagaaatctcgtgttctccggaatcaactgatttatcatcagacatctctgattatttcgacgcttgccctgttaggcttaacagtataataaataaaaaacgtattcgtagtgggaacgttgaacttttcaatcgtgtaaccttgagtcttatcgttttagcttacaaatagacaggctaggttatactatcactatagtgagaaacgatttaggttgaaactgccaaatgcttaacaaaacgggccttttgaggcagctaagttcgtcacaactaaaacagcaaagaagggtgacagctaaatcttgactatcacacacttcatatggttaaatgtttgaagaattatgtatttcttctaacgccaaactattccgtgaatgcgtttctaagatggtaaagatgtactcttctttacaccaacctttccatcattatatctcatctcatctaacatttcttattttcaaagaaccggtcaaaatgtcaaattttctagtacaaaactttccacacgtgtttgaggagaagaataatgtgtcacgtgataatcacgttgttgaagtccgtaaaagtcattctctcagttagaatgggtacaagctacccttggtagatggagatcggacaagactgcatcgaacagcagtaaatgttatcttgcctttgatgtttacatattacatgggcattgtatactgtgtctatgcgatccggttgccgagtctataaaatgcagaactggaatcattccttaggttgagatgaggtatctatccttggagatggcgagaaaagtgtatgtacgtagtctcccatattaaagttgggagtcttaagtaaagatccgatctttgattgagaatcgttgaattgatctgatgtcattgatgaagcagacaatccgatcctagatggggttccaggcactaacagttgttgatcatctgtcgttagtcttcttcttggtgaagtgaacatggaagtcgatggagattgcatcaaatcatgcatgctgttagttgggatcatgactggttgtttgaaagtcgattgtggtgaactggacgaggctctctctttcatatgtgacaacctaacgatatcatttaactgtgattccggccccacagtggtctggttgatgtatgcatttgatgaaggtgtagatggaataccatggtttatcattgagttcccatagttgctagatgcactcggcctccttccactactagaaggatggttagccgacgcatatggacttgttgccaaatacatcaacagatccgcaccttcttcgttgagtacttttgagtcactgcccaattgggaagagctggccttcggagttgaaggcactgcaggttccgaactgtcgtccgccgatttctcaccgttaagaactgttaagtggtccatacgtgtatccaaattcttagttttcctttctgtcgcgttaaatgacgacgtaaaagtgttcccagctgtgctaccgtctacagcattattcctggaaggtggcttcatagcagaccttctggttggtgattccgagatatggtttggcttcgatactgatctcgctctagatctgcctgcagacgttggaatgttaactgaatcgggacctgaactgttcccttttttattcctgttccccaacgcaacgttggaggggttactcttcttgggcgaggcaactttacttagccctagcttaagttttctagccatctgtgccaattctgctctttccagaattttatcagcaagctcctgttgtttcttaggagatagtgaggacattatggatttttgatagctttccttttaattcctcctaaatatacgtgcaaaaatgcgtccaatttcttagattaaaccctctaaaaattctatatctcccaatgtatattttggctaacttataactctccaaaagcgctcggttggccctgttcctctcccccaagctcgatatagatcgcgtaaacttttattctgaaatggaaatcctcatcttctcacttcatagtctctcatttcagattttctatcgatattgaaaagaaaaaaaagttagaagtgcgataaagagagagagagggaaaactgacagttactgaatgactctatggatgatgattgatataaactgaaaaccagtatcgcatcaacctttcggaaagggaggcagttcaaagagttcaaatttaaattttctattacatgatgaacagatttggtttggtcgttcgcaatgctgcgaagaatggaatcagaatcataagaccggttacaaagtcatcgcctgaaatttatcgtccactatttagtcacctggtgcgtactacgtacaataccagaggattccatgcgagtgtgcgaaagcttgatgaagcagaagatgctgctgctaaattcaaaaatttagggtccatgaaagtggataaaccgatgttaatgattgcgttcacttgtaagaaatgtaatactaggtcatcgcacacaatgtcgaaacaagcatacactaagggaactgtgttaataaagtgtcctggctgtgacaatagacatcttattgcagaccatttgaaaatctttaacgataatcatattactatcgaggatatcatgaaggcagaaggtgagtctgtctcattgaccaccgacgatttggcatttgaagatattccggattcgttgaagaatgttattggtcactacgcaaaggatgctccagaagaaatgaagaaaaaactggacaacgaaaaagtgcatcatttgccaagtactgagaaatgaatatataccgaatgcttgctcttacttctccgaagtaagagacaagggttcgtaatcacttatttatagtttacgaatttcgtacgagcttttttgtatacacatattttatactacttcaatcattcatgcattctttttgacgcaagtgctttcactcagagccattttatggcctgtttcttgtgccttacatcgtgaatagcgaactattcttgacatttccggacaaaaatcgttaacttagaaattccagcttctgaactcttcagatttacctgtatagatacgcaaatgaacaatatgtacagaaagaaatctctgataacaccatttgatgatcgacttgtcaatggacctgttgtatgtttgtgcaggcttacccgacagactaattgttaagcaaaatgagaggactacagttgtttggaggaggaagtaggagaagtgttgaaagcgaaaggcctttattgaataccaaagagtcagttttagtgcctactggaccgcaccttttgaagttaccagataaattgctggaacgaatcctggagaatcttgatattccaacatacttgtcactgatacaagtcaacaagaagttatatcagctaatttgtgaaaggtttttatttaaacatgtggttttaatgaataagaacgcattgttaaaattcaacgctttgattgaatgcaaaagtcttactctgagaaatgatatcagttatctggtgaaaactgttgaattcgtggatccagaatatcatgattctctgttcaaatatagcaaatactataacactgggtttgcggacactgtaataggtggctcgtattcattcagtgaaagacagggacgatcgacagatatcagaacatcgtctagatctgcatccgtgtcctctacaagatcaagaactaaacaaggtgcttcagaggtatatcatcaactttccaaacttgaatctaaattccttgactacacttacattgaattgatgctaaatatcatagattcacttcctaacgtttcacacgttattctctctcaggtggagaagaacttcaagatcccattatggtattcagttttaaatgatggctctaaggatttcttcaagaagattattaaaggtcaagggtcaatgacagtagaggatttgagaacatttagggtttccagtgattggattaaacaatacgaggaaacattccattctctatctagattcaaacgactatctatcaaggcgaagactaacctagttctaaagcctaacttgctttgttgctttggtgtttttgatgagttaatgttggaaaatatcaccattactcctgaatccattgatacaccattggaatatttgccgctatatatgcgaataggacacgacaaatgtttggatctacatcttccagttcaaacattggaactcaaatcctgtgtcatcaaagctggtaatggacttatgagattattgtactcgttctttttccgtgtcagaaagttatcattgtttgatcttcaaagtaaatatgatctccttttgataaattgctttggttctctcacgcacctaaccatagactgtaatagtacatgctttgtcaatgtcaaacctactgatgagtcatattattttccagaagaacctatgcaggacgatatggatgatctcaagacactgatagaccctcagaaaggtgtaaaactaacagcaccaccgccaactacaccagtggttgttgtaatgagcaatgggaagttaataaacaccgaagctagcacaccacggaaaccagcacttttaacaacagaacaagcacattactttggatcctcatcgatatctcctttccattcttatttccatcatttcaaaagattgtgggaacggattccaaactcaggagtacatttgacaatagttaatatccccttcacgaatgtatttcccttagttcctgaacttgtgtgggaacgctttttgactagtgatcaagacaccctctacgataattcagacgatgaaaataaccatgagttggacgagtattggtgggatccaaaaataaaagaaaatcttgaacgagcgactcatttcaataatgatatagacatctctgaagaagatttttcacccaggaaatggaatgatttccataggattaactctttcaaggacattcctaatgtcaacgtttggtacttcttgaagcttttgtctaagtttcagtccgttgagattcgaatgttacgtcaatggttgttctgcactcctcgtacgagatatgattgggaactcttattacgacctgtgttaaatggcagagtacctgtcacagtgaaggataatgctggatatttgttatattcctatggaaattctaaaaaaacatgattgaaactatatctaaaataaagccaagcaccatactacatcctaagatgaggtttgttctagagagtcttaatccatttcctgagtttgaagcctttttttctggtccagttaacttcacggaacctacttcattgacaatcgagaactttgggctcctacttaactgatttccatttgcatcatagtatttgctattgcaagttaagtctgacttgtctaaattcacatatttacctttatcgcatttaacaccctttctgataaattcagtggctaatttcggaactactttcgcagtgatatccaaattggtgtatttgttggtacatgcaggactgttgttaactatcctagatgtagacttgtcttgacttatttttaagtctgtgcttgttggatgtggtgtttgcttgtattggtttttgagcgcctcaaagtcctctaatagataaacatcgccggtctcttcattaactgagaccaagccgtaattgtttacttcttgggtgaactcataaactaatccaccactgaacgtatgatacattctatcagagtataatgtcggtatttctccaaattttctcggggtcacttcattacatccaaattccgaaaagaatactggcttagagtagtctttgtacgcatctaccaatttgtcatatcctgagctttggaaatcctgatcgccgcaccactggtaggagtttacaccatagaagtccacagaagaatcatgagttcctttatcttcgcattccaaatacttggataatgatactctatatttcaaatcatcagcggccgaatatccaacaggaattgctcgaggagagtgagctttgatgtaccccttcatatctcccaccaactgtttaatatacggtggagatctctgagcagaccttttgtcgttgattatttcgtttcctgcaataaagcctaacgtgttattataaggaatgaattgtgcaatcaatttgaaaacatgttctaaataaattggattataagtagtccagggttcatatcgatttaagtgctgatttattaaaggtgagttcacgtcaaggattagatatattccagcacttgctagcattgtcatacatttatcatggtttagatctggatttaacgaataaacacgcactgcattgattcccaaatcctgaaacaaaggtatatctcttgcacaaacggaaacatctgataagggatccttttcatctgtaacgtcactagatccacctggttgatagtcaatacctcttataaagaatggttcatctgtgacagaatcataaaagtgttttcctcgaatttctatggggtgtatatcagctaaaacagaggagacaaagaaaagtacacctattatcaatctatgcattttcttgaatgtgtatgtttatttctaaattctgtgttgattgttgcagggatatcaggcttcactgagatttctgcatcttgtatgattgcagatatgaatttttgtgtttatatttcttatattataatctgtcactgacgcagccaattaccaacatatatatgaaaaaatagtaaataaaataacacatagaataaccgcgtcatcttaatatagctaaggtgacacaacgtagttcagtacagatgccaatgatatatttgggatcataactgctgattcgtcgcccaaaatgaaagtacttttttaaaatgataattatgatgttgaaatcgaacttatacacaaaaatatgtaaaaaattataagataaagaaggtgaactcgtcgaaggtagggtatatgtaaccttgttctgttagagtttgacaatacattctgacatcatcttcaatcatgttcaaagattgagagataagtttagtctgcacagagaaagagtttgaatccttgccagcgcactgggctctgataaaatccaaaactttttcagtggctgattttggaggctcgttatcttgtacaaataaactattggtttcagtattagctccgttaactgccaccgttgagtcaacactcaagttaccgttagccacagcaaatgccttaattacctccaggtgatgtgctagaatttcattgaatgaatcaatatgctttactacagcgtattgtacattcatcttaccactgaattctcttagagaagcgtataccttgatgtatttccctaccgagtagtcttgtgctacttgcgagttataatcaccattttggtcctcttgagaggcgtgcgacatatcattgctatcattagtccattttcggaattcgatttgcccagtcccatcttcaactgtaagagtaacattcgatgtattatcagcaacgtttctaatgacaccaacaaatgacacatggtgaagttcttgacccattataacgtatggtccatcttgaatttgttgctttgcggattgcatctgtttaattgtcacaggagtcaaagtgttggcattttgtccaccggaatttggtctggaagattggcttggatctgagttatcaaatccaccagcattaatattagaatattcattatatggatgataagctggataaaggaggagtggtgattagttttattgaaagtgttagtaatgggaacaagactgaacctaaataaatagtttcggaaaaacatcgtaacgtactggtcattgtgtcagttttctttagcttctgtttattgactccttctgccgaagataacccagttcttggttatcctccattgaatatcagttttgccattcacaaagctcatatcctctcttcagaagattatgaataagttacgcgttttccctttcaaagatttggttcgtgtttggcagggtaatataaataaagaattagtatggcagaaatcttagcacagtatacaaggacaaagaataatgcaaatatgtggcaagaaaggatactgtaaccaagtttaatttcctctcggcagcaacattaggatggaatttgatgattacaataatatttatatgtaagttaactaaataatgctgaataagttaatctttaatctcttctctttctcttcttattcttcaatctttccttttctttagaggtttgatgagcttcaccgtcgttcagaggaattgctaattcatcaccggtgaggccttcttcggtattgaaaactttctttctccattcccttagtcgcctgctcttagtaacctttcttctatcctttgacgtcagttcttttggtctatatggtgcaaacttcttcaagccgataaactcatttagatcggcgtcatcagctgtgaatatttctcgcgtagtcaatccgaatgattctggagacacttcacggtatctaaacttaacttcagaatttttctctgtcgaacgtcctctttcttcttccacctgctctatgatgtctaccttacgttcgtcgactgctttttctaccatctcatgtaactgcttcttatctttttttttgtctctcttctcttgtatcttgtccttctttgatttcttcttttttggctctccagagtctgatgccaaggtctcatcgtcttccgcatgatcctcggtttcctgttcagcataaaactctcccatgatatcgtcattctcatcccatgttggtttatcttcctggttgtagaattcgtcgttaaagatggtaccgatgacttcatcccatttcccatcttcgaagtttccgtttattaaggtatcggttaaggctttgacatgctcttctttgatatcagcaccatattctttctttacttgctctaaaacatcagtaagttggttaaccttttccttctttttcttttggactgccttttgcttctcttcttcctctttatccttaatagccttttcctcatctctctttcttctacgagatgaggttgcagatcttctgagtgtagcttgtgtacgtgcataagaaacaatttctgcagcatttggatcctcgtaacggaaattataagcattttcaaattgctcgacagcatcgtcaaagtcctcatcttcttcgatgtcggtaccacgacggtccaaattaatcactttatcgcctttctttggaatccacgcctgttggttaacaaactcctccaaaaacttttcgtcatcaacttttggattcggtaatttgacttcggattcccttttattttgtggctccttcttcttcaagaagccgtcttcttcttcgtctccttcttctgcatcgtcatcgccattgaacgcatccttgatctcactcaaaagttggtttctctcttctctttgatgcgaagcaaaagactgtttaccatccaccgtttcaaattccaaatcctcatcatcatcggcattaacgttaccatttaaaagattcattctatgataatctttcaaatagacgggtttatgtttctcagtctttgccaatttttcaactgccttttcgggttcttcgaaaaatttcactcccgggttcaatagtttatcagtctcattatttttaatagcatctaagactttttgaataccttcttctacttcttcagtgatcaattcaccataatcatcttcttcttctgaggtcgaactatcttcatcgtcatcgtctacttcagcaggaacctctttagaagcagtgacatcatgctttgacccagttttcacacttatgacctcggtattcttgccttcaacgtcggtagttggaaccttcgttgaactgcccttcactgcaactgactcttgcttcttgatggcttctctagccttcttggcagcagatttctttctaggcatttatgtataagaaacttggttcacttatgttaaactgttctttgaggaaaaataatcaacaggatacgattgcccaagttaaatagcaatgaaagcctcccttgatgctaatctttcctctttctcattgatacagattcgatgagatgcgatgggcttcagtttgtaaaactttcgctccatggttttcgatcagaacatgatgaaaaagaaattcaaacacgtgaccgctaacgcagagaaacaggtcctggttataccgtttgtagtctgtgcgcggacgtctttcgaaggcgcaagatgtaggcaagcctcaaaaacggtaatatgggcttcccacagataattgttgggtttagtactcagttagaaatcacacaatcgtcgtttactcacctgcaagctgaatctgcaacgtattatttgtatctgcatgatattctcccatattatttcataggaaaataaaggaaatccaacaagtgtgagctttaaagaagaatatatttaaaggtactaaagtaaaagtcaacgggactgctggctctatttgttgctgaacatcttgttttaacttacagggtaaatacaacggttattttttagattgaacagcttacacgcctaatacaatggacacctcacatgaaagactgtttcgtttgcccttcaagttgccaacttcggtatcggccaaaaaggtgtgcgtttatgtagctggtgccttatacggtgcgggtctctggtccttcttagattgtgtgttgtactccaagcatgcaaatggttcagatttgcacatttcatttattgactgggtgccaatgctatgcagtgtgcttgggatggcaattgtgagttctatcgaaaaaaatagattgctacaagacgctttatcctcaggaacgttcaccggatctcaatctactgcatggcaggccagagtagtacttttcctaggattttcactgttagcaagcggcatttccggttctttggtcgttttgattgttaagtttttattgaaggattatacctcctatccaaccttaggaatgggaattaacaatgtgcttgcaaacctggctattcttctaagttgcaccatgttatggattggacaaaatgtggaggatgaatataactattcattgactctatgatgtgtcaatgaaacttcgtgaagtatcatattggattgccgtatttaagaacagtgtacagatatagccttctgcatgtatacgtataaataccttcccaattttaaaacgtattagaaacggtcaattattcctatgactcaacagcccctctatgagttgtacatgtctcattttattatctctggaacacaattagcatgaacggtaacgtacgataaattggtaacgggctaagcctggagtgctgaatgaagaatatcgatgtattagaagagcgtagaattaataataataataataataataataataataataataataataataataataataataataataataataataataataataataataataaaataaaagattaaaggtaagataaacagcaggattgaaaaacaatgatgctgagaactggatttagaggacgtagaatcatcggaaagactgtccttgagatagtttatcgtagcttgtgaaatgcattgaagttgatacaaaggattacagaaaggaaaaaaatgtcaagaggcaagaatcaatcttgctttggctgtatctttggaaaaaggtcgccaatgacttgcaattcgaaatcagagaagtcataaagaggaggtaaatgtttaggttgtgaacttccgctagggaagaaatagcgctcatttcttaaatcatcaaagaatggatgtgcaaggatccttcttggagaagctcttctttcaggttcgtataccaacacactcatcaacaaatcaacaccatctggtccagcgtagccgaaatatttctcgaatcttgcttttggagctccttcaaataatggcttggagaataaaggtccattgtacgatggattagaaaaaaagatgaaccttttgtcaggaggcccgagtaattttgtgatttcatgtagttgtaataatggttgatggccttggaatactgctttacctaagagcatttctcccaatacacatcctaatccccaaatatctatctttgttgtgtattgtgtacatcctacaatcaattctggagctctataatatcttgaacagatgtaactaatcgatggttggttcgattctaactttttcgctgatccaaaatcacaaatcttcaatatacccgtttgtggatcaaccaagacgtttgaaggttttatgtctctatggcatattcctagtgcatgtaggtaaagcatacctctagcaatttggtaggcgtatagtttaacgtgcttcaacggtaactccaagttattcttcttatatcgtaaaatttcgttttgtagcatttcgggcaagcattccatcgccaaatgttggtataatttatgatctgttggtgagatatgagtgtagaaatattccaatttgacaacatttggatggtccgcaattcgtaaaatctctaactctctagatttatactcagtctgagcaggaaccttcttaatggcaaaaggacccaaccacttctgattatccggtgttaggtaagcttgcaccaccgtgccaaatgcaccttgcccaattcgcttatattcctttacgagcatttctcgcttgacattggatttattactgatgacatcatgagccacgtattcatctaatctttgcatagacatggcgaatcgcaataaggggaaagaagacagatagtaacagatacaaaagcgatgcgatatctatcgaataagaaaaaaattaccactttttgttcgttgtatttcgctcaagtcttcaaattacaaacttcaaccgttattttgcaagcaaaccttagaatatagatatgttcctaacggatgtaacgtggatggttcaggaaaaaaagggaaatattgaattgtaatgaatcaataaaatctgtattaaatgaattgatgaaatgaaatcgctaatattaataaaagcaacacaacagggggaaaacactcttactcaagcaagtcaattagtcccttgcaacaagtgatgcagcagtgtctataatgtttcttcgcagtaaattcttcgcgctgcaatcgctcggcaaattcaacaactagaagttcccagaacttaaacgtttgagcacccttagcagtgttgtgtccgttatcagagaccctatttgttactttgaaacaaggttctggtttattttttgtttgttttttcctaatttcctaaaactaaaattgattttcatattcggttttccaagaatctgatatcaatatgactgactgactactgactgagttacacaattattgataaaagcgatataaaagacgttctaattgagggaacgttccaaacaaaatttaattctaagatctcccagagccagcttttatgaagttcgactctgagagtactacactctctctagatatgaatgcacaaacgaagttaaattggcatttatagcattaatgaggaattactcaggttcaggtcctatatcctccacctgaactttctcttgattgtagcatcaagttgtagaaatggtttggggaatgcgaggtgatcttcgccagtctgcatataatatttctatcaaatgtttaccccatcgcatctcggcactctttatcaacgtgatatcttccgccagtggactgcaggcacttcacattaaaggctaatccttatacaccgggtaatgacaagttagtcacgtgttaatgcaacaccgggtaatggtttatgagcatatcttgaaaatgaattgggaaaacagaagatatttagagtttgcatttcatagaggaatactattcgtctgagtatggagacctgcattcgagaaagacacaggttgtggttaatataaatcggcgtcgaaaatacaccacgatgctgagaacattagtgagactgttcagctcaacggccaggacaaaccaagatgtggcttccatcttattttcatctgtcaaaggatcagaaaaggctccagtgatggaagacaccaatgttgtccaacctaatactcttcgtggtagcaataagaaagggagagtcgatgaagcagtgataaaatatatattgaactgcagattcactaagaacaatacacatttcacatacagtgccgtaatggaggatagaaactttttggcgaacaatccacaattatcctacaacgaaaaatatctatactatttgaaactcccacaacaggtcaaatttcatttatctactggtcatttagggttccgtaaagctgcccgtggtgaatatgaagcctcattccaaacagcaactaagttatttgaaactctttatcagaagaagctactggataagaatatagaaattgttatgagagacttcggtaagggaagagatgctttcatcagtgcattgaacggtaaggaaggaaacctcatcagacgtcacatatctagagtagccgatgctactgaattgaaattcggtggtgtgaaggccccaagaccaagaagattgtgattcggtctctcaccatttcatctttcactaatagtctctgtgtatagacatgaatttggaaaataattcggtataataacaaataatgcatgtatataaatttaacgtaacgcaccagaattttcgtttaaatacattaagacagcaattcgaagtatgatttcacacaattatgacattgctcatgccttataatctctggatgctaatttcatcgaagatttaaaattttccggaaagtagcgggactgttttgtggatgcacggatttggctttagattttttgtaaaaattgttaggtattttagtattccattttaggtaattaaaatttcaattggaggttctaaaaaaaggaaaggcagaggaggcgttccggctgccaggttctcaccgttctccttctgtcgctccgttcgagtctagtcttcccagcgagaggactctgattctgcccactctcccctctactcgcactgacattctgaggtgcgtaggcaggaactgctgtccatccagcctatcatccattccttccctgagcctggagccatatcctgtacctgcaaatcacagtgcgattgtgctacctggccagggataccctgttcgtgctgaatattcctttcgactacggacagtttcgcttgcgaccttgtatctgtattgtttcatcaaaagtaatattgaacgttttaaagaatatttcaatatcattcggtattagagtacacttgattagcattcaaagaggccgcacacaaccaagacacaaaaatggctccatctagtatgttactgagatgcgcaactgaaagctacatgctgataatggtgggataacgacttaccgcgggctgaacaagtgagaatgaagatattaccttgagagtgtaattacacacctgtgggagcaaacgaatggtagaataagtacgctaatgagaaaccaacaatacgatctgaataattgtacatgatattacctatgtgtgaacctgtcatgaaagcggatgaacatcaaatgaaacgatgaacacaaacacgctgcaatgagaacataaagtacgagttatcagccttttaaatgatggttaaacaactactatttcgattagatccttaaattggaatactttatcatgatacgtcgaaaagttacgatgcgtagttatacggttcatcggtgtttatgagttaagttttttgaaaacatgttaaaaggcccactcgacgctttccctgtaccgttcagagcataaaatacaccttacatttaatacacttaaagtcaattctctagttttacagaagaaaatcatgccgttatcgaactagttatccttcaatcaacatttaaatccagttttactaacaaaatttcctattattattttttccacagctaaggctactgctgctaagaaggctgttgttaagggtaccaatggtaagaaggctttgaaggtcagaacctctgcttccttcagattgccaaagaccttgaagttggctagatctccaaagtacgctaccaaggctgtcccacactacaacagattggactcttacaaagtcatcgaacaaccaatcacttctgaaactgccatgaagaaggttgaagatggtaacactttggttttcaaggtctctctaaaggctaacaagtaccaaatcaagaaggctgtcaaggaattatacgaagttgatgttttgtctgtcaacaccttggttagaccaaacggtaccaagaaggcttacgtcagattgactgccgacttcgatgccttggacattgccaacagaatcggttacatctaatcatttttaatgtatacatatcaactgaataaatcgtgtatttcaattaaatcattttagtttcaaataaagaaaagaatggatttcattaaagcttttgagagctatcaatgtatgagacgttaacagcttgtaatattgaatctgggtatcgactcttgagacataaagggtagttcagaacatatttttacttggacataagatgtatttacatgttttgtaagtatgcaaaaggtgttaatcgtcttgatttcttgacatgatccgtagaatgtataaaaataggttgatgatatccaaatacaacatcatagcacatttgatctcttcaccgacgagaacttttcttaggattaattgcgtgtcgacgaatatatagactgtgaagagaataactccaacccaactcattaacaagtctgtatttgtgtcaaagtggaagaaaatagatgatattgagaaccctatcattacccacaaaaacatattcaaccaatagtaccatttttggaagtcatatatctggaaatagtttgtagaaagcaaagtactggtgattccgataacaacgaacaaagtcatcataacggcattaagtatgacctctcctttataaataaccaccactatggataatgagtaagcttctgccattgtgaaaagtatcaataatgctaactgctgagggaaggatagtacgtaccatggttcattttcctcatcagtggaggatggagcaaaacttagccatatacatgttaccaacccgatgaaaatggctataaaactgagccacggtttcgttataatgaataattgtaagcctggggtgttataaacgtatagtccaaatgcaaaggttaaagtcaactgaaagagcaagatcgaatagacattctttaaaaaccctaatcttatttcattctcgcatgaactgacacttgttgaatatttgaaatcctctggtacaaagggtgttgtctcagacatatcctatagagttgtattgtatatgatgaacgtgttgttgggaaataggtttctttgatgaagatctctcccttaactcttattttatgtggtaatgggcatgtttaaaatctgtcttcgtaattttctatgttatttttttaagtatctaaattgacaataaggttcataatatagaaacatctgaaatataatagatgatttgaatatcgttaataatatatgactacttaaatgagtaaaagtataaaagaaataaatatgtgcgtaaatgatagctgagttgagcagaagattatgggttagttgatgtgatgatggacattaaaatttcattaaaaaaaaccgttaataagacgtgatgagaacgatgacgaaacccatcagaaaacaaagaaaaaaatgatatgcttataaactggaaaatagaatcaaatcattataccaattttagaccagtttcgatgttcccctctagtgttttcaagcaaattggcaacaaagtgtcacgttcgtaagaatcaagattttccaaaatttcatagtgaatcttcttgataccgtttcgattaatggataatgggatagaaaagtatagtaaatcgttgatgtatctagatctcaattcattggatccaggtgcaatttcttgatgatttctgtttgtgagtggaacgtacatgacaatgtcgtcgatggtatctgtgttaccaactaataagtcaatgaatttagctgcgattttgaatccagcatatgccatagacagtgttgcgctaccattaccgttcttagccttgacgatttcatcaccaccgtactgaactctgtgaaccattttcagtctcatgccattatccaacaaattagcatattccggatccctctccaacgtagagaaaacaggaataatggtatccccagagtgaccaccgatgactggaatcacaggggatgtgtttgatttaaaaccgttcagttgttggacaaaagtggaagacctgaccaaatccaattgggtgataccgtacactcttgattcgatgtttgagttgccatttgcatcgcttctaatcaaagtattagtcaatagcgggaccaaagagttgataggattagatataaccaaaacatgaactttgtttaagtcacagtacttggcgatatcttcacctagcgatttgatgatctttgcattgacaccaatcaaatcgtcacgtgacatacccggttttcttggaacaccagctggaatgataaccacactagcattactcaagcattggccaataccaccattgctgtcatccgggtagtgtgctgttgttgtgattggagtatctatgtgggataaatctgctgctgtacctacgatggcgtccttgttgacatcgtataacgacaaacgaatatgagttgacgtttcatgtggtaacaaaaaccctgcgttcgattttaacaatagcgacaaagattgtccaataccaccagctgctcctagcacagaaatctttaagatctccttttcttgagcgttaacagcaggcatttctttatgaaagaagttgaaattaataatagttttaataataagtgctgtgaggattagtcgtagcacttgtcgattacacacagaatcaaaagagaaagacatatgtctaacaataagaaggggggtacaaaaatgtttcgaaagggaagacaatgcctattcaaacgaatattcctctctttatatatacatatatgtgtatatttttatatttacatttgcataaaaagatatatgcatgtaattataatcgatgatctattcggtaaaataacgtaaacttcaattaaaaaccggataagattgaaaccgaaagataaacagtataataatacgaaatcaaacgaaataattctggaaatccacaactcagaagtaccatcatgaattgcttagacaagaatactagaaacgtacctgtattgttactaaggcttgttctttgatcatccattttgtgtaagtgatgatgcctacttaattgtaaataataccctgtttccaggccagatagaactgtacacagaataaaagcagttgcactacaaaacggattttctattgagtagagaacattgaaaaaaaatgttttttttttttgttttttttttttttggctcaagttcttaagaaaacggctcagtgaaaggaattacttttgtgatctactggcgtcaaaggggaaatacctagaaaagtgggtaattgtcatagtgaaactgttgaaactgatgataaccgaaagtggtgtttgttagttaccaggcacagaattatcgaaaacagatggagttacagtaaacccgattaatgactgtgacgcaggcgcaggaccttaagaccatttttgttccgttatctgtccatacaggcgcgttaccctgagaataaggggttacaacaagaacaaaatcattagaataaatcaacaatcctcagatattgctgtagacgatgatgtgatcagtttttccgtgaggctttaataatggctcatgcggttgtggaatcaggagaaaagaaggagtaagcaaaaaaaatacaacaacagcgctgttggttgtatgcccgctgtcccaagcttagatccgaacaaacgcaaggaattgggggagatagacattgaatggtgttccgtttagtttcataatgtataccataggatgtaagtgagaacggcggttgattcggtcacgcaaacgccaataagactgttaaacatacgcaggattttgtcagcaagattcttttctgccgtttctttttaccgaaaatattcttgtgtcaggtcattcaaagatgacagaaaaacgtgatcaatgaagagtgggcagaaaggtgggttgactgcagcgaccagattaggcaacagaaccgctgatcatgagcatgtgaccttaaaatatcatggcttacgaactccaccaaaccacttggctcttcgattgttagttttattttatttttttttttttttacaacaagagatttgtgaaatcatcatctcgagatgagatacgagatgaggtgaaatcaaatggtttgtgattgtaatcatggcgtcttttctataagccataattgaaacataatgatggctgttacagtatcaggaaataccggacagtcaaccgctgaaagactgcaatgtgagttttttctcgtgaaaaagaagcgacagtgcggaatgacaagacgagctggttcccagttctgttcagaacactctactgatagcgacagagttccttgtccattggacccttctcatactgtgtgcttgagtaagatgcgtgtgcatatgaggaaatgcaataaatttagacatgatgtttcatatcaagcaaaacagcgcgaaattccatggtttaaagaaggacttaattccatcagtaacgggaagtcagacagtaagccggcagatgagacactagttaagtcagtgagtttgattcagaagatatttcaaaatgaatttggtgacgaacctccgttgccattaatcgagaaacaaaacgaactcttggaacgtacggaacggtacaagactttggttaataggaaacatgcaagacaacaatcatcgttgattcaacatcttaaagagtccaaactatggccaagtttagaatcatgtgcagtgaacaagacactggaatacattgaacttggttgtgggagagctgaattttcaaggtacgttaatatcgctacaaatctggaccaaaaggagcattctcatgaaaagccagagtacaaagccgtcgcaccctccttcaccctcattgacagagcctctcaaaggttacgttttgataataagttcagttctgacatcggaaccgaagttcaaatcagacgtgagaagatcgatattaaggatcttagattggatgcagtactccacgatgcatctcaatacgtggctatctcaaaacatctatgcggtgtggccacagatttatcgctaagatgccttttgaacagcgataaatgcaaggcaaaccttagaggaatacttattgcaatgtgttgtagacacgtatgtcaatcttctgagtatgtgaatcaagagtatatcaaaggtttactgaaaagacagaccgatggttcgatggcgtattcggaattcttccaatgcttaaagaaattctgttcctattgtacgtgcggattgagaccagatatggaccccaacagtggttcggaggaccatataacgaaattgacgcacaacgagaggcaacgcattggacacatggcaaggaggatcatagatgaaggaagagcccagtttctacaatcaaaaggcttcgaaacagttttgttcaagtacacagacagcgctgtcactttggaggacactgcgctattggcattgaggaagcatgattaaaccaggaggaccctccgcttaacctacctgtacatatcttacgtaaaaaagtgtatcttctggcagcataatgatgcaggatgcagagaacaaaatgtggtactaataaatgcaaatgcactgagagtttgaattgttttcccgtgctacgagcttcttaacaataccctagatggaaacaaaggtcacatgtacagtaacggttgcccattgcaataagggtaacaacaagatgatgacaccgccgggacaaaatttgtcccggaatttgagacggttttccctctccgaccattataatcggaacaaccactccaacagtgggagttaccaaacaaaactgcacggatttcttccgttccccaaaaatttcagcttcctccattaaaagtggaagccctatttcacgtgagaggtggcctgacagagaactgaacaaaaaaaaaaaaaagaaaaagaaagccaaacaaaatccgcagctggaaccttaattactggacgcccgacttcttgaaaaacacactggcattaaacaagaagctaccagaatgtgttcacgtacaggcagttggtgttctgtgttcttacaaaaaagtttcgccttagtcgcagtgagaacgtgcaataagctgatctactcaacgcaactgacaaagactagcaataactgccacatgatattctcaaaacccactttgcgatgcaattgagcgatgtataatcacaccaaccaacatacgtgtttctagaaattggcagttttgcccggcctgattgcctagatagtgcagtggcagttggaacacctgtcgcaagctctcttcatatcatcatctttatccctcttttctgagtgatgttctgtctggataattatcttcttccgtctatcttcttctaaattgatcagtatcataatatggaaaaaaaggttgttcgtgaatttttcctccattcaattcatatataataagaacaatgaattgcatacttcccaaatcttgataattcgttttaatatctatcagtagttgtttatattcaattatatcttgtgtatacaaaaccatcatccaaaaaccaatccaagtttcgtttgacttataaccaatagtaccaaaaattaaaccttaattttgaagtactttataatttaaacttaatacgaattaaaccaaaaaacccacaacacgtaaaagaaattacaatgccagctcaagacgtattgaccagaaagaccggtgtcattgtcggtgacgatgtcaaggctttgttcgactacgctaaggaacacaagtttgccattccagctatcaacgtgacctcttcttccactgttgttgctgctttggaagctgctagagacaacaaatctccaatcattttgcaaacttccaacggtggtgctgcttactttgctggtaagggtgtttccaacgaaggccaaaatgcttctatcagaggttctatcgctgctgctcactacatcagatccattgctccagcttacggtatcccagttgttctacacaccgatcattgtgctaagaagttgctaccatggttcgatggtatgctaaaggctgacgaagaatacttcgctaagcacggtgaaccattgttctcctcccacatgttggatttgtccgaagaaactgatgaggaaaacattggtctatgtgtcaaatacttcaccagaatggccaagatccaccaatggttggaaatggaaatcggtatcaccggtggtgaagaagatggtgtcaacaacgaaggtacttctaacgacaaactttacaccactccagaaactgttttctctgtccacgaagctttgtccaagatctctccaaacttctccattgccagtgccttcggtaacgtccacggtgtttacaagatcgccgctgccctaaaaccagaattgttgggtactttccaagactacgctgctaagcaattaaacaagaaggcagaagacaagccattgtacttggtcttccacggtggttccggttcctccaccaaggacttccatactgccatcgatttcggtgtcgtaaaggtcaacttggatactgactgtcaattcgcttacttgtccggtatcagagactacgtcttgaacaagaaggactacttgatgaccccagtcggtaacccaaccggtgaagactctccaaacaagaagtactacgacccaagagtctgggttagagaaggtgaaaagaccatgagcaagagaatcactcaagctttggaaatcttccgtactaagggtgctttggaataaagttcttttgtttagtaccattatcccaaacaatttaacttataattttctatatacaatttaaataccagaacgcatgaaatgatcaaatgaagacatctgaaccattagttacaaaatgattggcagggatccgctgtgcatcggatacgttcaccagtgttatccttggacgctaccgaggacttacctgttatcgaactgcatttgtctttttctctcacgtgatcgactttgtctcatagtccagtttggcttaaatatgaaagcagagttaaaaaacataggaacagttacaatcaaacaaagtcacgttcatagtcccttaacacaattacaactccagaaacaaatacaagaaacagggaggactcaaagcgatggatttttactccaatctcccggtgaatttacaacaaccgactttattcgaaatactctctgtcaatgaagtgaagaagttaatcaaaccaactttaaggtatattttctccatttatctccaatatagaggaccaacacgatggctgttgaagatttttaataaatttgacttcataatcttggtgattaaatctttggttgaatacagacattataaaacaacaggtgccacaattcttgacaagttctatggattgaaaaggttttctagattccctaaattaacctttctaggaatttggttgaatgactgtttattcgaatacgttagtgatatctgtgaacaataccatgagctcttgcagtccagaaaattgacgagcccagaattgagctcatggcaacaatggtttgatgcctattatcctaagctacagaagactatcaaagtgataaatttctgtttcaaattaaagtacttgcgtcattcaaaagacactgatatgatccatttcataacacaaataagataccaacgataccaagaacccgaagaaggaattgcaagtaggaaaaatactttaactctttctgaacgtcgtcgtaaaagaactaatttacccagaatattagctatgaccaaggatgcagtggagagcacatcgaccatgttcttggacaagttattcccgagcttcctagtgatgatcagaattttacaaattatcaatcagcggcctgaattattcaagaaagagatacgagtaaagagaccaaaacctccagtactacctggcgtagcatcagaggtggataacaatgatacgactgacgtatgtcccctatgcggcgaagaaataacagaacctgccatgatttcatctggatatgtcgctaatttagagtgtgccaagaaatgggtaagcacagaaaatacatgtttcgcgactggtgtgcccatagataaacgcatccgtaagttattaatatagttttgcattaatttagtaaatgaataatgagaataattgagccagtagcattagaataattctgcattggtttccatttgattgaacatcgtttgcatcatcattatatcagattccagcctagagatttctgaatctaagtctggagccgatgttctactgtatcttagctttaataaccaaatttctttcaagatttcatcgcttggtctatcattatcttcaagatattgaatcatcctatccaaatgatcttttaaatcacgttttaatagttttaaatcggaatgatcatcctgaatttctactccacagttgattagcttataaggatatcgtacactctcatgccattgtatcaaattgctagtttcagggaagtaatggaacttggatttaataatgtattgtttcgaattcaacgactgtaacatgtcatcgtaatcgtaaatgtccgggtcaaccattaggattccaattggatcagaggatttccagctgaaaaggctgagcttcgtatcaacgtttccaactccatcacacagaaaacactgtgatgctatttcattttccaatacaaggataaatagtaacggacctcctttactttcaatgatcgtcgaattaacttgcagcagaacttcctccttcaaatccatatcttgatcaaataatgcagaacaggatctagctataaataaggcaaggcctcaagacacaactaagtttcgtacaacctccttttttatttcgttcgagtacaacagtgtatgaattactattatgtatttgtatattatatttacagggaaagaaatctttaaaagttgatctcaactgaaaaggattatgtggaaaacatacattgctgatgcggcctgtctatactaacacttcgccttggtcaataacgacattctgttggccatgcactggttcgtaacagtaccatttcaacaaagcgtctgtagcggctctggctttagcttctttcaaagatgaaccgtaaccctcgcctaatttctcttcaccactgaaaacgccaacgatgaacaagggtgatttagacaatctaccgttttctgcaagtagtttcgataccggtctttccaatccttggcgacggcacaaagctgccagttctctggttggttgttcgaacgcgaacaaatctttaacgtccagctttctggacaaaatatgatctgcgataaacttatgtgtctggttgaaatctttgtcgacactgtatacagcggcgaatatactccttacggcaactgccatagcattgttctcagtgaagttatgcaattcatctacggaattttggaaataacgtagtttacccaatgtaatggtaacattttctttctttgcatatctatccactacactttgagtttccggttctataccccaggaacgaccgacattgctcaaaacatggtcgttaatatatgcatccacagcagcattcaaaaccacacccggtagcctaggatattttttcattagctcggatgtaactgccaaagttaaaagactcttaccaaaaatgttcaaactgacattgtcatagttcacttccccactagaacgacacgtcaaacatctggacaaaagagaataggataagccttgaggcaatcttaatctggaatggagtgcaactaaattggggcttgttagttcatgtgcagggttctttaacagtgtactgatggtattcttatattctttcaatgatgacagttctgattggtacaacctggcacaagaagcaaatcctcgcactcgcacagggttcaatagcttcaaaacagacatccttctttaacccccctcgatggtgatgttgattgctgtatatatcaatggcaaacctcaccaatagctcactgcatcactcaacttctttccatcctctctctgtaactctttcactaaaattttttttcaatatttcgatactgagatctgcaattacccggatatagtagactgttgatgttttccgagtagtcacgtgataataatatgttttcacagacatctcattattccagattctttctgatacggcgcacttatgctatggattgtcgatgaatcggtagctaaacatatttacagactattctaaactaccataaattgcagttggaatcgtaatggtagtctacaaggatcccactctcatttggttcaatttttcgcaaaaagtgatgttcagcccaatgttgcgacggttttatagtgttccagcgacatttttccatcctacagtgtatgcattatcaacgccatcaaatcagcactctgcaatagctataattaggatatcgggtacacattcaaagtatatcttaaaaaaattgtcgccaaaaaaaccgctacggcagaggaaaccgatgattcggtcattatatgatcccaaggcatcaactctgatagatgaagcgttagtcttgtacttcccacaaccacggacctttacaggtgaagatttagtggaattgcatctacatggggggaaagctattataaaggcagcgttaaactcaatccagggtttgcgggactctgaaagagatattcgtatggcgatgccgggagaattcagtcgacgagctttccagaatgggaaaatggatttgttgaagcttgaaagtatcaacaatatgattcattcagatacagaattacagcgattgtctgcattgcatggcaatcagaccgtagacattttccatgaatggcgacaagagattatagagcagatcgctaaactaactgcaattattgattttggtgaagatatcgaaacggaagatatcgattctatagtgaatggtgccaatgataaacttttacaactatacaaaaaagtgactcgattcatggtgaaattagatagaatggctgtcttgaacgatgggataaagttaacattgttgggtgaaccaaattccgggaagtcatcattagttaacgaaatatctcaagacgacgttgcgattgtcagtgatataccgggcaccacaagagactctatcgatgtaatgatggacattaacggttttaaatgtatcttgactgacacggcagggatcagacagggaacttcagattctattgagatcaaaggtattgacagatccaaaaagaaaagtttacaaagtgacttagtggtattggtcattgatgtatctaacccaaatataagtaaacattttgaagaatttatcaaggataacttatctgataaacctttaattgtcgtgttgaataaatcggatttagctactgaaacccagttaaaatacttaattgaaaagttcgatgcagaatttaaagccctgaaaattcatacagtctcttgcttaaccaaaattggattggaaccattagttaagaccttgacattaagtttcagaagaatctcggcaactgagaatgaagatccagtcaccgtgtccaatagagtcaaagaaattttaagcactgatattctattcggcctagatcagttcttccagcacaagaatgacgatatattaatagcttgcgaatcacttagaatagcttccgatggaattgggaagataactggtgataacgttgacttggaagaggttttagacgttgtcttttcgaagttttgtatcggcaagtaattgtaaatagttttcccattcatctgccaattcttccaattcttgcacttgcttttctagtttattcaatctgccagaaagccgttgtttctcatcgacccaatcactaatgccgtcatctttcttgattttactctgtaaatattctagtttaccataattttgttcagtctcttgctcaaaactcgacactccagttgcagttacgaaatcaattctttgctgaatcccatccaccaattcttcgagtttggatttcaaagcctttcccctcattttaaagctttacgttcagacaagtggtctatgacacctgtgtaaagacgatcataggattttgatgtgtcaatattcctttaaattgatatgaatatttcaagattttgaagttttaaacaataaataccttaaattaacataacagagttgaacatccacggacaaccaacgaaacagtaggatatgggaagttcagcgagtgcaaaagtctggcgcataatccaattccacagtagttacaatggttatatttgtccatgaatttgatgtacttaaaggtaatacgttggtatggaccaatggtgatgccaagactttggaagggttagaatatactgttctaccatcaggcattcacctgagaaatacagacacagtatacttcaaattggatgggaaaccgggattagcggtttttaaacagaataccatggagctcgaagcctctcaacatcacatcgatcgatcaaaggtaagaatgttcagttttgggacgatttttgaccatcccatggactatgaacagttgtctctttatgaaggtggaatgaaagatgccttagaaagatggtggaaagaccaggattattctgtattggaagaatgggatgaaaagcaaaacggtgacgatacttctaactttgattttaatgggacttgtctaacgataggtccaattgtgttacaattatggcgttgtgcattacttcaggaaagaatattaatcttaaacaagggcgttgaagtcaaaaagtgcaatcagctttgtcatctattaactaaaatggcaagtttagagggtggaacttactgtaatgccatgacaattacgatgctaaatgcggatcagttcaagagttttgaggcctggtgcgcgaccacgagtgatgaaatattaatatacgatacagatctcttcgacaagcttgttatatgggatcctaatggaatccatctcagggacagtatgaaggaaatcaaatgcaatgaagtggatttcacagttttcaagtccttgacctcagatgatttgtctaccttcaattatcaatacgaatcttccataatttggtccaaacttataattgatggattattcatgcttttcacgggaaatttatacaaaccatggtatcatcttgagttggctccaattgaacatccggattttgttcaatatttctccgaaagaacccacgatatataccagcgtttaaaagcgatagtggaactatttcctactcaggattccatttatcaaaatgccaatattttgatagaccttcggttggactacttcaatgacacggactttatacggcaactatcacagcattggttcgagaaacctgtcatacccagttatatagaccttagtttcttattttaaacgagatatacgtttaaaacaggtttctacttaaatatacatagtttaattaactctccgaaagtatacatctaaattatgagccaaacaactgacccaataattgttataccaattacagcggtgatgataccagcaccggcttggtcacctttaccgattgttaagggtgccaaattagttggagattgttcggtacctgcagctgggttaccagccgaagtaccaccgtcgtcagctgtgtatggagcaggcctgtccaaacatcttaggttttgcataacttctaatgcagccatttgttcacctaaaccatatttaccgtcccatccaccgtagaaccagttcaaaccacaagtatggccatcagtaccacctgaacatgaatcagcagcaccttgagccgatgcttgtagcaatgctaaaacagtatctctcgtctctgggactaactgcgctgtcaaacctaaaaatctagagaaatatgccttgaaagaacgttgatcattgttacaataacctgaaccttgacaagcggcttcatacatgatactattattaaagaagataccggaagagtttaagaaattctttgttctttcatgccaggtctctgattctgtgaaattgtacaagtaagcgctaccggataacattagcccttgattgtatgtccactgatatttcacagtgtcagtacaattttcctcgatcgaggcaccgtcatagacataatattgggttggctcctcatcaactaacaattggatatcttgcatccaatcgtagattttttctgcccattctgtgtaagaactgttcccggtataacgggccaatcttgcagacaaatggaacaaagccgcgttagagacagagttcttgtaatcgtaaccggagttccaggtgaaaatttgccatctaagaccaccaccacacgaatccatatcccaacgagatgacatcgtgttaaacacagcttgtgctaaatataaccattgtggttcatcgtcaggagggtttgggtagtttctttcagcagctgccataacagcgaaaccccaaaaggcttgatcatcgttaccttcagtaactgtttgattcaaaggcatatagtcgtggttatcaccggtttgatacaataaagcttgggtaagtatatcgttataagtatcattttccatataaaaccagtaatctaggatggaaccccaagcaccaccggcttgccaccaataactgggactagcaaacataccaatagttttaccatactgtagaccagtataatagtccatcagaccatatgcaacaagagatgtagcatttttcaatgaattcaaatcattaacatctagatcaagaccaaacgacactgaactgaaaagcgtcacaagggacagcaccagcttaaaaactctcatactctgtccacagaagacacacgtctaaacagtatagtatacagagcgttgcaatccgattcaatccctggatgtattagttctaccttagtagctcaacacagaccatcggatcgggtgttcgttttgattcaccaaaaataattatttcaaactgtgcgtaattctctctttatggtacatgtgcgaaaaatgctgaagagaacaacagacttattgatagaaactaaaaggatagacaaacggcaggtgaaaccactcaatggtggtatcatcttcggatccagtcagtaagacaattactatttttttatttcatataagtatatatattacccgtaacgaggtgttttaacaaaccttagaaacctaaagattttagcaagttcaacttgacctgtctttcgaattccggtctattgtctctccatagaatgcaagcgtcgatgttagctccagactcaatgtttggttcacttaggatactcatcacactgagcaatatcatttcgacgctttgaactggtgaccatctctcacactcgtgttcgtacatatttggatcagacccaggagagtgaagaatggatatacacacttcaccgttaggatagatattaggatgtagaatactaggttggaacgtaagttttggaggattcaatggataatctttagggaaatccaatcttgcattgaagacgccaccttcgtagcaggaatccggtggacccatgatcaaacaatcccactggaacaaattcgaatcatcaatcggactggcgagtattccctctgggctatccttagtcaatttctctagttctttcaacaaacgtttctgtgcagtcttggacattgtatgctcaacccagttaacttgtgaacaccgtactctctatgcttttacaaactctttatctgcagagtatattgtaaccttgtttgtatgtgtcattatcatcattttcgtcaataactttatacactttcagatattagttaatgtggtgtaagaaaagtatcagccaacagagatataatggtggtggaactgtgccgaacatgatacacctcgatcacgtattgacatgatgtttaacactcaactacctggtggtatcgattggtttgaacgaagatggaagtcacgtgattaatgtgctgttcacatcttatccgttacctacgcgatatcacagatctctggcaaatgcctcatgtgtgtgtgtattatacttagaagaacccaagtactacgctacgccattcacaggaatgtcaacttttgtacattcccctcttctattaatcgctttctgtctcttgctgtcatctcatcgggttaaaaaaaattccgtcaatatgattaaagttcaaacaagaagatcgacatactcagcaaagacatcatcgattataactggcaaagaatataggtcatagcgtagtaagccgtctattattttacggaagtagtgacaccagtcagattggttaaggaatcaaaagttcgtttaattattcttcctatattttgacttgccaagaataacgaggtgcagaaaggatcgacgaaaactattgtgacagaagacacctatcgaaaggattactgtgttaatatagaagaagccttccaaattctaatttgaagagatgataattttcaatggtgagaaatattcatgtgtttcttgcattcgtggacatcgttcttcatcatgcaaacacagtgaacgaatgcttgtgaaagtgcggacaagaggcaggccctcgccgttagatattcgcaaagtgatattggtcgatagagcttcccgagttgaagaagtagatggctctggtcaggataacggagcgggggacgagtcgcagttgtgctgtgggatgaacaagcaaccggtactctttttaagagctattgcaacgaagaaagcgctcttaatcaacggtgacttgaaaatcatggtaacctcggagtctggtaccccagattatgaagttgctagaaaggtatcagatgataataaattcgttactgaacatgaatttttgctcaaccatgtcagtcccccgccttgtaaaagttgcaacagcactgtgaagcgggagaatgaatcccattctttggatgcaacaaatacaactgagaattatgccaaacgtgtcaagttcgaaagacaagatatgacgaatttatctaaccatgaacttctttctgcaggtgacaatgttcagttgaactcggtaggaaactcaacattccaagattctgttgtagaactgtttacacaaaacggtgcctatttaagtactacttgttcatgcaatgagaactgtcaatgcaacaactgtctgatacatagagaggaagctgaattagagaggtatttgaccgaattaaaccaacctatgataaatctagggagtgcccaaattttgactgccgatagctctcaggtggagccatccaaggatttcttccatggcgaaacagatgaccaaaatatgagtacactgtgcctttgtgaacctgatttctgtacttgcttcaattgtgaagcgcatccagatgaggtagtaacgctaagcgaactattactatacggggtattgaattacaaatggaagaaaaagatggtcataaaatacagaaacaaggtaatacactctaaatactggtggcattatctcactgtcgaaattccatcgatgaatgagaaacagcttcggtctctcgatttgatggaatggtttgataatctaataagtagccattccgctgaattacctgaagcaaacgatttggttcactttacagatagccgggggaatgctcaccatgggaaccaaaatgacaatactaaaaaccatataaacattaacaagtcaattcaggacgatatgaagagactgatgccaaatttcggtaataataacgtcacacttaaaaaggatacacacagtccgaagggagataatagaaccttacttaccggcacaactactgctgatacccacatgaatatacacgatccacttaaatttaataatctgatcctgtaaatagtttttcaataatataattggcctctcgtttaccactttcccaagcaccatacgcacatccagcaccgtccattatcgtatgctctccagcaaacctcaaattaccttgtccaacgttcaaagcaatcactaagtccatagggtcatcacctggttgacaggcgctgtatgcaccaagagagaagggatcagaagaccaattactagttaaaatattcttcaatattggagtttttgattctttgacttcatcgtttaagtctgatatgtaatcactcgaacccaaagagttaagcaacttattaagtacaggtctgaagaattcttctacttcttctgttgtcaaagtttcaatatattcagttactggttgttgaatcaaggcaacaaaagaagcagtatcagtatgcttggctaagttcaagaaacatgttggatttttccaactatcttcatgacttcttggcaatttttgttcgatatcttttaacaaggttttgagatctttagctgatctaatggattcgacaaaatccgttggttgttcatgcaccgtcaatattcttccactagttttggaccatttgatggaatcgaattcaaatataactttacccagagacccaaatgacgccttcgtagttattgcctcgaatatatccccattcaatggaggttcaaacccgatacgagctttcctcatatgagaaaattcattctcctcctgctcacaagatatggccaacacagattgtggtactgttacaatgcaataatcacacaaatatttacccttgtcagtgttgacttgatatttcccatttgacaatttcttaatcaggttcacagattcgctcaaatggatcttatccttgactggattcgaaattctagccaaaattttgtcatagtgtaaaactaacgcatttcttccattgtgttcaatcccagaccacttcccacttagtgcataccaatcaacaccatgccacaattccatgtatcttaacaattgtggtaaatggtagagctgttcatcggtcaaaaattcttttctactgaaacagaattcgatacaaagttgaaaataagacacgtcttctacgtcaagtgaatcataatatctcatctcgacccatttctcaaattcatatgctaaacattccaactgatccacttcaagaactcctaattttttatcaacgaggcatgccctgtcctcatcatcgaatacaaaccctgccctttcgctctcgggcaacgacatttcttccataaacaaaccattgctcaaagtatcgtgatgccaagacccgccaatatcgtacttgccattgcgaccttgtctggtattcagcctacctccgacacgatcacgtgattcgatgcaaatcaccgattctataccactcttgaccagatcgctggtagcttttaacccagagattcccgctccaatgacaataacactataatctgtcatgatgatacgaagcgaagcacagtgactgcgggaccaacagacagtcgttaatcggtgcccggaatgagacaagtggttgttaagaattgtcaccatcttttttttttttttcctttactaatgcatactggcaccaccgccattaaggtagtcaaactggtaagaaaatcctagaaactgattgggagatcattgagtcacgtgaacatatttgtggggagaatgcaatcccacggtacaaaccctggatggacatgtccggcaagttccacggccaagattgaaaataacgaccctattcccaatcgtttgccaagaattcagaccctcattccgttaacgttgggagtaacgcctgttagctgtcgctcaaaatgtctcacattactactacatcttgcctagcccaacttgtaaatctagttaacggttttgcctattgcattacttactactcgtactttctttcagattcgccggctactattccgagctaaatataggaaaacctggaaaccacactgcaaataaatacacaagccacatacagacacacacagaaagacacacacctagatatagaccaactgatgcaggaaacctgacaacctcgttcggttcacgtataaggaactgactattcatagttacgtcctgttcccaccattgctattctacttccaactcgttacaagcgcaccagcacgaacccgccctcttttcttttcaagcacgcctttattatagcttgttaaccgcacttccactgtgtgcgattttgaaaattgattgacagtggcttttcctgaaattcgaatttgagtttgtttttctctgaaaacctgtaaacttggctaatgataaggcaaaagagaaaataagatagataagttaagttaacttaggttaggttagactagtttaagataagtttcatcacctagagcgaggtaaaagtgaagtgagaggtctctaacggaaacagaacgatattttaactggtagtattgtaagaggtacatatttttgagtcttttgagtcttttggggttttaactttatttgatacattgcgtgtgaacagaaagagagaaagagagaaagggcgtgtgtgaatattgaacagcagcaaactaatagtataaggcaattgtgactattttttagggctgaatttcaatctagttataaaattacacgttgtgcacacacagaaattagagggaaaagaaggacagaaagcttgagacttatcctttaactcaaatgaaccatcaagatttatcgttatccggcgatgaaggccattcttcgtcccagagggatagtgtttacgatgatgctgggtcgatccatagtgagtcttcgatgattttcgaaaggaacgtcgaggacccgtattcgcaagttttctccaatccaaggcttgcatcgttatctaggtcagcttcgaatgcaaacttggcaccttacgattcgcacgattcgttgcacgataacggttcgggactgtctctttcgaaatcctcttcgaggaagcaatcgaacgctggaagctttattccacatcatacccttgaaaacttggtggcaccggcgttagatgaaggtgtgactattgtaaatgatgattctactgacttggagtcggtggaaatgatttattcgagaagaccttccactatcggattggacatggcattgggcaggacaaggaccaattcatcatcggatgctgccactttgagtgggaacaactcttctacaacaagactgatgaggaccaatagtgcctctcaggggtctggcctggaaaccagacctagggtgttacgtttttactcttacgccgatatgatatcggatgagaactcttcatatccaagaaggccttccataacacaatcgctttcgtcgaccttgttgagacaacaaggtgctggtacgcctacaggatttgatagccacagagcaggaaactctccttcaaatcagctgggttcaccagatttttctaatccattcttgaacaaccaggctatagctgctgcggtagctgcaaacggtgggaacagtggacagggtgttagtcccttggaatcacatagaaaactttccaacgtttccattccaccactggccgttgctacaagacattattcggggaatctcgcgtgccgttccccaaatactaatactacaaatggacatagactgagtacttcccctttaatgatcccacataacccaaatagtgcgttgttgcgcaagagtaactttcaaatagagtccagcggaagtgaatgttccgatgatgaagatccggaccaacatcgcagtaacagcaacagcagcaacagcaacaacaacaacaacaacaacaacaacaacaacaacaacaacaacaacaacaacaacagaaatacacagcatcgtggtttagatcatgatgtatctagtgcaggtacactgaacaccccaccagtaaatcctcaaggacttcgtttatcacgtacttctactcagggatctggttttaacaaaaaattctctcctccagcgtacaagacaagagcgtactccaatgctagtggagtttcaccgtacgcgaataacttcagtagaagctccgtgtcaagcgcgaatacccatatactggatgatgttttttatgatgagcaacttcaatccaatacggcaagcgaagtggtgaagaaaaagttgactaacgaaatctaacattaaaaagaaagaataaggatgatccatgagccattcagcgcgcttttaaatagaaggaaattgctacgtttatctgttttcaagcaatcacttgaattttctggccaagaacgggtcatttattttttccgtctcttctttgatacatcttcttccccttcccttattttttctctcgttcagcaactctttcccttaccgtctcctcggtacagtcaatcgttataactctattttgaattaacattctatttttatttatatcgaaatgagaaggttgttattcttttatgttaatttacttacgggtgttttctttttctctttctgattctttttatcctatctataaatacagtgactgaaacgcagttgcttcatgctccagggtttgctaatatcatgtaattgtgtttaattttcctgtatctcctcaaacaacataccctttccgtcgttaaaacgaaatacgtttgatagaattctttccactagcaaaaatgttatactttgcttgattttatggacattatgatggaattgtcttattatgcttactataattataaatagtcctttctactagccgttctaacaaatcttcttagttgccattctacgtcagcatctttattttctaatgttcctaattttaattcgaacaatctcatctcgaacctaggtcccacttctgctaactccacaccttctctggttttcacataaacatgttgcctaacgctgataaaatctcctctgtttgcaaacgttatcacccttgctgcatctttctttggaccaggtgggaataggtgctttaaaatcgtctctactctcttacccaatggtgttgtgaaattatcgaagattagatgtggatttacttcactttgattccccgaatttaaaatgtcatgtcttaaaacgacgttgtgtaatgtgaaaaatgctgttggaccatgtgggaaatgtgataccgttagtgatgtaggaacacctctatgttcatgaagaacaaccaaatctgacgttcctgatgtttgacaggcatcgacaagattcggcataatgtaattacctctgtttaatcttaccgctgttgggaacagtaatttgatttcttttgcaaactgtgataacctagtactagggtctctagatgttgtcacaataatcttaggttctgcgataccgcttgttgcgctgtactcatcatctatctgttcctgagcactttcatcgtattgaaaatctttctgtagttgctcatcttcagcaatttcctttggtagtggtttcccctgtgctaacgcttgctttatgatttggcgcttttgttgtagttgagattcttgtagctcttgtgctttacggtacaagtattctcttctttcacgagcttgccttcttaacatcgtacttcaataatgtgttgcttgtatagtaccaaaaaagcgaatagctgataatatactataataatgcctgtttatagtgactacagtacgtatatacacgatactagtccgtcgtaaacaaaaatgtccaaccagctaagttgttcttcagctctaacgtctcatctcatcgcatcgttcatgtaaaaatttcagcctcaaaaagaaataattattagaataataccaaatggtcacgtgacaaaacctttatacaaatccataaagccaaatacgctaagaaacgcattatcgtaacatcggttacatacaacagacactgtaattggtgacatattaaagaattacttggttgtcattaaacgaggttttatacagtctatcaaaggtaattaatatttgtcgtggatgatgtttagtaaatgaaggaaattaccttcacttcttgacacatctgccatatgctctagcgaagctttcttcttctgagatttccattctagtcttgaggaagaaattgtttctgtttttggaagggatatccatcgattcacgtctcgatgctacctttttggctatttcagtatcaaaatctgattgaagacttcctccacgtaatgccatcctttgttggtggacgttattaggcaaaaacatatgggtagaaagagcagtaggtaaaatggtctgagcagccggaggtgcattcgattcatgataataccgttctctagtagtatcgcttacgatactactaaaagagccgagtcttctggaacgctcaaatgcgacaggaattggcttttgatgatccaaaagaggtttgttctgccacgaacttgatggtgtcacagagcccacagcaactatttccgtagtttctggagcaacaggttgaggcggtatttgaattcctgttggattctgatgtaatatgcaattttgatcggtcttctttctcagaggcttttccgattgtttatccaaagactttaagacaggtttctcaacagcctttgctgaagatgttgcttcagaaacatatagtggtcttttgagcaaatcctcattggttgtagtgtatgctttatcctctggatcaacttgtgacttggtttgtttctcttgcatgaatagaccagacaacaaacttttcttctctccggattcttttgaaggcacttgatgaacattattgttttggtgtgtctttgagaacatcagcttatcccattggttttcataatattgatcattatcttcttcttcatcgtatatctcactatcatctgaaagagagtcccaatcagattcttcgtcctcactactaaagaacatattcttgtgatcttgtccggcatgcacatgcgctgcattacttatagtaccagacgttccagatttggtgccattactagatgtatgagcgatattgttggcaactgatgacgttctcgaggaatgattcatctcatttgatttgaggttttcagcagatccattggcagatgaattagtagatccattggccggggtgaatggagtaggttgatttttcgcaaataatgatttactagatgggtttctactgaacaaagaagtctgtgagtgagcatttgactttgtttccgataaaggcacatgatttgacaccgggggttctgatgatgatggtggtaaaggtaattgttgttgatggttcttcggtacattgaccaattcaggagaaatagcgaatttcttctttgccaaatctttccgtagatcaggggtgtttgcctgggaccttgatggaacctccattttcgtcggtagaggttcaggtgaagaacacacaggtgatatcagtttcttcgaaattgagatatgaggtcttgttgacgtaatatgcgtattagcagtcgatttcggtatcgaggccccactagagattggtgtcaacagcgcagatgatgaaccggacgatgtcgccgaggtggaagctgcagttaccattgtagttggagtctttggtgacgccggtgtcacagcttttggtttctgcagctgttgctgcagttgtgggaataagtgcgtttgctttataggattaataacgtgatataggttccgtacaccatcccgtctctttgacttgttgatattctgatctttcaacaacgacttattaatgatcctccaactaaggttatgcagccgttctccttgctccatgaatttgctacatttgatcaacgaagtgtataagtctaaagaatcgaacaacggcagtttatcctgcgtgaaaagagcgggactcactttcaaaaacgtatgattttgttcatgttctacatcactactcgcgtgtagcatctggaaccgatttttatcggtacagttaagcatcttgggatccatttctcgcctgcgtattgaaatcctctgatccatattaatctaaacagtatgataaggtgaatagaaaagaggtaagaccaccggaggaaagacggtgcttcgtgttgaagtaaaaacaaaataataaaaaaaaaaattcgtgcgaactctgaagtcctatgatgccaagcgataacagattcttcgtcttttactgttcagattgattactcgtggctggtctttggtctctttcctctgttcaataacaacagttataaatcaagttcaacaagttaaagcacacctttaatatgggaaataatgcctgacctgaccttttttctatcagcactgtatttctgtttctgcttatgatcgatgaaaaagaaaaaaaaacctggaatgaaaccaagttgaaaaaagcgtgctaatcttttcaatatagcagccaggtgatgtaggaagcagtagcaatagtagtagcagttgaatctcaagttgaataacaatacctgcgtgtgagaggaagaactatgtaaagtagatagttctaatccaaaaaaaaaagggaacaaatcatacgtagaagaagtaaataaacaaacaaggaaggaacatatagcgttttagttatatatagcgtcggtggttccttaatatagtaccaaggtcagctgcatcgagcagaaaatcaagggagcaacaaaggaaggatggaatgagacgatcatttaccgatatatctttatcatctatgccatggtaagcctctgtctggcatatcaagcaacgaaacacaaaatagcagcagtcattcaagcagtcattcaggcaacagtcggtcagtcatcttcaatgggaaaatttcaaaaaaaaaaaagtcttattcttcggtttaccgttgtgatatcaaatcaggtcacgtattttatgtttttccttcctgtaatcctggatcacgaaagtcggggacattatgggggcctgttgccttgggagaagcgagctgagagacggaaggcgagatcagtgtatgctatctccatcttttacacggatgaggggacagggggaggggagaacagtggggcagggatggatgcagttaagtgtttggagacccgagtttggggagtgcggcactagaatcacgtgattgaaagttcggtctctggctattttttttttggagttaatagtatagtcttactgaatacttcatgcatgcacacatacttcaacatgcaataggaatacggtttacacttggtattttaggttgatacataataatatagttttagatacgttagttagatagagacaaaaatcaaaatcaaaatcattaatacgatgttttagaatgtgagggagggggcaggtgaggagataagggaaaggaaatcaatcaatcatgaattatttcttctcttgtacgtagttttgtgccttatctagtcccttttgagtggattcgtgaacaccggcagcagcttgcttggcagtatgcaaggcgtcgtctgtactactccagaacttaccagtagccttgtcagcccagtcgtttacggtattaaccgcagattggtaattcttttcagcatcttcgtatttggccttggcagctttttgtagttcctcattcttttcagcaccgaattgccaccagtgctttgtgtgcttgttcaattcagcacgggcatcttccaatgacttcttggcagcgtctgcagccctttgggcgtcatcacgagcggtagaagcggaagcttggtatctcttcttaccggcttctctccatcttaccaagtcttcgtattcttcttgggccatggtggaagcggtttcaccccaaccttccaaggccttagcagccttttgagccaggaactcttcgtccttacccttgtaggtgaaccaaccgtcttccttgattttcttgaaacgatccaatcttctttgagcttcacttggtcctatttgtctgttcctcaccttctcctccatctcttcctttgctaagagttcggcagtttcaccccatccagaaacactatggctggcaatagagtctggatcaacaacctccgcgtcggccttacctcttaaccaactcaagaaccctttacgtctcagctcttcttcgttgtcgtgtacttggttggccagcttgttgaagtcattggtggtcttctcagagaattccctagtggcttcatccactcttctcttggcatcttccacgtacgccttagcctgatcaacttgcctttgcaattctgggtcacctttaccgaaaaggcccttctttgactcgttgaacctttcttccaactcttggtattttttgcttgcattatcgtaattgttgatagcttgagcacgagccttctcagccttgttgtagccccagttcaaaatactgactgacgtgtccttcgcattctgagcagcttcgttcacggtttgcttactgctagcagcagccttggatacggattctttggtatcgtcgatcttctgcgagcttctgtcagctatttcgttcacattctggtgaactgtgtcttgcacttggttgccagtaccaacgattgcggacttcacacttttcaggtcatcgatgaaaccttccttgatgttaccgagatcagtggaaatagcacccttcgtgtccttgtagacttgaacgacagcgtttggcttgtccttgttttcatattcctgaacgttctctcttagagtgtgcttattgtctctgtacttgtcacgtgaatcttcaatcgtgttctttgcttgatctaatttttccacggtccaatcagcgatgccagctttcttgccctcaacctgcgaggcaatgtcttggaacttgtaatcggcctcattcttgtattgtgacattttgtccttcacatcagtggttaaatcgtccaatttcgcaccagtcttggcacctttcctttcaaatgtactttggtcgtgaacaactggagacacgggaacagccccattttgctgttgtttcaactgaacttgacgttcgtacaacaaatatccggctgctgcaacagcaacacctccgataataactctgttcgacatgtttcgacgtacttagtttctttacttcttggtttttttttcttcttaccttaattctttcactatacttaaggtcgatgatgctctttacccttaaaatcgggcaaagcagaatcaaaagtatgcccaagacatatatatatatatttaaacttaccgttgtttaattcaatcaagatacatcccttatatatatttacatatatttgcccatccagcagtcatgccgaaacaagtcgggttccctgccggatacccgtcttagctaatagcaaatccagaaataaactacaccaagaattgtgaaaacaaaaaaaaaaaacgatgctattcggacaactatactcttgcaaactggaaaactaactccaacaatatggagttaagttaaacagctactttttttttacccttgttcttggtggatcggtaacgtgtagatacagcacaccaatagaagctctggatcctttacttaggtttacgtaactatctctgtctgcatttctcaagatgtcgacaacatcgccaatggagattatattctatggctttcttagatcattgtggaagactcacaccctccaaactaagaaccccttcctcattgatttccactgttttgcactgtcctttttccaactggcagctttaaaccactacactcaattacgcaaaatgaggttggtctttgtcttaagaaaagcctgtatgtccctttaaatagctaagagcaaaaacgttttcagagcaaaaaaaagggtacattacgacagaacgtaggcagaaagcttgagactggaagaatgctaagactcgtcttatactataggagagtagtttgttgatggcttggttacgtagtgtttgctggagattttcggaaggaagtgactccggatacttcggtactcttgctccgaaagctccccaggttatggtaggcggtacctaattcgggctacagtagggtaacgacaaattactctcattaggatatcatgtttgctttttcacttgtttacttcacagatggaaccatatccactatggtcacttacggaatattatgttggctgggtatatctgaccggttcgagtcctcgaggtttaagaatgctgtcaaaattgctcgaaggatcaagttgcgaaatgtaatccttgactcaataatctcaagtattttaaaaatgttagacccacgaatattgatatacagtatatcctatatatgtgtatatacatatcaattttaaataactttaagttatacccaatggtaatgattacagttcttgatcatcggtttccgttcccgtagcataatgtagtttgaagtaattagaagaaaaaaaaaaagagaacagattgagaaatgatgaaattctagattctataagtaaaaaagtccatctagaggtgctggagatttaataagagccaatcacgcacaagtaataatatataacaagttaggccgtgaaaaggcgggttttcaaaatgcaaaggttgaattgtggtgtttggaatctcttgtaactggttaaggatcaatgctgtgattgtatgcaagtattgtatggacaactggttaaagaaaaggaaaaagattaaccaagaattggtaaaggaagtttgtgaacgcatgctccctggaagtgaatgtgtattctataacatgttatgacgtgtcatagatgtgacaacatcatatgtcacgattgtcgaaatcatatgtcgactgttatgagtagcggggaaatggcgtggttcagttcatgtgacatgattctgttgggttataatcgtagtcgtatgttgtgttgtaatgaggaccatcacgatcagcgtgttttcgtttattaggtgaatccctcttagcatttttgaatttcgattgtagatcttcagtggtgaaggtactcaagacttgctcttctgcgatatctgaagaatttatcttgtagctcttattgttaatactgtcactgagaatactggatatattttcatcttgaacaaggatttcagagagtttattgattgtatcagatttcaactgttctgggaacttcacacggaatctgatgtataaatttccgaaattgccattactgtcaacaggcatacctttattttcaacacatttgatacaaccaggtttcaacaattcaccactcaatacctcaatcttgaatgggttcccacttggatggtcttcaataataatggtcccaccacataaacttgtctttaagtccacttcaaagttatccaatatgagatcgtgatcatgtaccaagtacttgtacctcatattactttcttcattcctggttagttggatggtgattatgacatcacctgggataacacgttccttaccgtattccgtatttataacttcgtcggcttcaccgggtagtatgatctcattaccgttacgcataccaggcaacacttcgacatcgaaaaatttcctttcttttatgaacccgtttccagaacattctgtgcatgcatctttactcctaatgtactttcctgttccactgcattctttacacgttgtttgccacgtttgaaccatcggacccattctctttgttgtagtaaataatcctgtaccctggcatcctctacattgagtagccttcttaccaccatatccttggcaccgttggcacaatctggttctatttagagctaatttagcacgtttcccatggaataggtcgtataaattgcacttcaaattatgacgaatcccaggacccgatgccatttcgtgagaaccatcgtcctcaaaatctgccatcgagttcatgttgaaatcatgagaaaaactctggaaaggtccatttaccattcctctcatgaaaccgaatccgctagcaccagtgccgctggacccgcgacccccaaaaaactgcgcaaacaaatcacctgcggtatgggcactgaacggatgagaattaccgttactaccagtatttcccatgttttgcttcgctattatctcactaatttctccctcgtctactgtaccatactgatcgtacaactccctcttgttactattactcaacgtttcgtacgcatggctaatatcctggaacaatttaattgattctgcactatggttgttcttatctggatggtgttttaacgcctttttcctgtacgccttcttaatttcttgttcggtggccgtagtattaacttctaaaatatcgtacagtttcgtattcttagccataatttcttagtgttggcttgatgttatgtaaaaaaatgctttcagacgcgatttataacagtatcttctcttcttttaagaatacttttcccgatctcttaatctttggctatcgcacaaaaataaccataatgttgactcagaaaactattacggagaaaggcctttttctgactttccttttaatttatcaccacttgcaagatatgaccttgaaacttgattatctccttaattcactagtgatgtcactctccaactatagctttggcgtgctttaagaatatcctcttatttttggtgttcgttgcacttgtctcgttagaatctcttcaatatgacaataaaacaaagaatatttcggttttctcgatttttcttttttttttagcttggtatcaagaatattatagtttcagaggtgatattaaacgcgcagcgctgtatcctgaaatgtattagcttttccaattaaatgattaaacctgatgggatatcgaagttaaaacagtacgagaagttcagttgataaattctttccgtatctcttatttgtgtttctatcaaagcttttcttatatcttctttcgatatatcagttttttttttttcgtttctacggaaaaaacacaatttcttaatgatacctaaataagagaaaagagaaggatcgaaaaaaaaggaaaaatatagacgtcagcatgaagaaacaaggatcagatataatcaattattcgctgattccaaacaaacgagagaccgatattctgtctttgctgagtactttcgtacttcgtgtacgtgtgcggctaagaatgagcggagagaaacatcaaaattttttgtatgacagtatgtaataatggcatatgtcccctccctcttaaagatcagagctccaacctgtggcgttaatcatatttatccctttcattcaactgctattagtcaaagaaaccgacatcttttccaatgcagcgataccaagatatagatggtgtcgctgcagtacgggttttccgctagttcttctgtccattttccctctgtgtctatctccatcttggaattacgaaagacgaagcgacacaaaaatgtatggtgcagttcggaattctgttcgtaaagtgtctggtacatatttgatgtccgcaatgatttctatgtactgaacggtactgcgaatattttctaagacgagattatcttttttttgtggcagtacagattgcgttttctggaactttcagcaagcttttaaagtcacgtgatcagaatgggaggagggattgattattacaattagtcgggagcaaagttatagtcggatgggggtatatcgggaacggaaggtatttcctttgacgatagttatgatcagtgcttttaatagggtttttcttgtatgcctcaaaggataccaaatcatctcgaagtgaaaaagtgaatcttttttgaaaaataatacagttgcccatctcagcattattcttgacatctggatctacacgcacaagtactttacaattcaagtccaagaagctcaccacataagggcagttggaccaattcagtcatgattctctcactcactgagccggtggttcctttagagtacactttggatctgaatgtggatcacaaacagccaaatttcaaaggacaattgacagttcaattaaaacaacgtcagcctggtcaatcattcaataagttcaaattccattgtaaacaattgattgtcaccaaagttctattgagcgataaaccgttatctatttcctatgatgcgaatgaacaaactgtgtctttctcttcagatgacccattgaacattgcagatgataccgcggagttaagaattagttacatcggtaaagttaataccatcaagactcatcgcgaattgaccactgggttgttcaagacaaatttcatgagcgataccactggaatcagcgactcttacattcttgcaactcatacccaacctgtttttgctagatccattttcccttgcttcgatgagccaaactcaaaatgtaagtatcagcttaccttgactgcagatgacaagttcaaagtaatcagtaacacatcggttgaaaatcgttccgttacagatgaccgtaaacaaattgtgaagtttagtaagactcctctcatgaatacttcttattttggtttctgcatcggtgatttagaattcttgagaaccgatgtcaaattgaagaataagaccattccagtacagttgtttgctccacagagtatttctcatgctacttacagctttgataccattgtagaactcttgcctatagttgagaaaaggttaggcgttgattatcctttggagaaattggacgtggtactgttgccatttttgtctgatatggctatggaaaattggggtttacttactttccaaatgaaccacctgttgctaacacctcaagctttgtctgacccttcggtgattcaacaggtcagacaattgattgttcatgaactttgtcatcaatggatgggtaactacatctcgtttgactcctgggatcatctttggtttaacgaagcttttgcgacgtggttcgcatgtgacttgttggacgaacacgataatgatggatattggtcttcagacgtctatctaacccagatggaaaatgtcatatcaactgacgctgaagtaactaccaagagtatcacacaaggttcggtaatcgacgtgaaatccttgcaatcaacttcagatgcatttgaaccacacatatatcataagggaatatcgttattgagatcactccaacaaagtgttgggaaagaaaacttcaacagagctctcgcccagatcttctcagagtcgtccacattccatgaaacttgtatcaaaccaatggatatctttagaagaatgggcgagatcctaaaatccgaaaacattgcaaacttctacagctcatggactaggactcctggtatcccaatcatttctgtaaatactgatactgaaaggactaccttggaacagcaccgtttccttttggaaaagacagatgttgaggacattccttaccatattccactttttgcagttcaatcttcaggagaggatgatactaagaatggattatttactgatagaactctgaaattatccgaacccgaacttattgtgaacagtggagccaggggcctataccgtgtttcttatgagacggataaatgctacgagttgatcaatgaagccctcaagaactctaaaatttccgatttggatttattcaaaatattcattgacctgagatctctaataggcagtgaataccaaaaaaagatacacatcgatggtgtcttaatgatattgaggtgcctggcatcacatgttgatttaacggaagaactataccgtggattatctatcggtttagatatcttgcaaaccatagaaaatgctttaagaacatacaccggtaaatctgagaaagctttcattactgatatttatgtccctctatgggataaattttcttggaatgactttcacgtttcctcatatcagctaaaagttatgtcaaaggtgatgtttggtatcaaacatttggactcaaccttgactgtggccaatcaattaatgaaaaagatcttgtctggtccaaataagtccattcctttggaattgtgcggaagtgtgttcgccactgtctcctgtcatcaaaagaatgtcaaacagtggaaaaaattatatgagctagttaagtctgcaaagggtgttgaatctcatgttgacggtggatcttctattgacattcaaaatatggctcttgagaatcttgcattcaacactaatgaggagctcatcaaaaagactttgaactttattttaactaatatcacttcaaccagtgttgaaaatgcattattcggattgaactataacttccgcgagccattggatggcaagaagaataaattagtccgtgatgtatgctgggagtggttcgagttaaattatgacctatggggtcgtaagtctctgagagagggcgcggaatcctctgaaagaatgaaaaagaccctggtgcacatcagttatgtgatcttccaaatgtggatggataaccccgaaaaggtcgatgagtttgtgacaaagaaaaacgctacgtatggtcaaacgcttggtacagctcaaatctggaccgctgttaaagcgagtgaaagctccaaaatgaatatctataaaggtattttaggcttctaatatccagatcataagtagtgtatacatatgaatgtatttgtaatgcaattctctcagaacagcatgaattccagaaacataaatgtttcatctgtaatccgtaaatgctcccgattaattaatttcgttatgacaaagtgtttcttgacgttacactgcgtatagaacgctcttcatcgattttatgcattcctggattgtcaggagggaagaaaaatgatcttctgttttggtctgcgcttgtcagtgattgtcgcacggaaaaaatgctagtgctcggtctggtcgacaaatcatcggtatcattttcatgatataatttctcaattgttccatagccatcagtattactgctattgtcttgcgatcctctgacgggcggagcatcctcattatcagaaattacaattgggttgccaggagacccaagttccaacggcggtgtaattgactctctgtacacgatcgcagaatttctcaccgacgaggcaaatgacgacatatcttcacccaatagacaagagattctaagctcgactcttttagctatgatagctttgaggtaagaattccatgtacggtataactcaggatttaatctctctgcaaatgatgttttattagctggtaacgtgtttgacctgcgaacatgtttggcttttcttgaaaggtttctagagatagatggccttttcacaacatttgacccttgcggagagtttttctttttattcaacaattcattaaactgcattaaaggaaccttaattggatggagtgttggattaactcgtaataggcttctcaatgaatttttggaataaagatacattctaatgttatcggctgttatcacctcagttatatccatttgagaggcgttgatgtatctcatgtacgacatcaattcctgttcattttgaaacctagacctttttctgaagtgagtctttttggtgtaatttcttcgcagtgaattaacagaattgtgtctttgagaaaagcccttatggaatatgaacttcttatctttgttatatttcgcatactcagactgaacagagaaatccttgcgcctaactgaagaatgcgttcttttaagcgaattgtgcctattcattttttgttttattttcttagaagagtagataggccatttggtgaataaactcaacagcgagtcgttattttgttccaaaccttgtcgcctattcttattgttcttttcctgttccacctggaacttgtcaaaatcggtcatatacggtaaagcagtctttccggcttctggtggtgcatcctccccaagcaatgtaactgtgggtatgggtgctgcgattgaagtaacgggactcagtctaagactacgtctgtaaagttcttcttcgtatggactcagcagtaatttatcattgggacttctttcttccaacgtattgaccaagtgaatattttgttcattcaaagaacgttcttgcatcccacttgtatatatagctctgtttgaatcgacaagagactcatgtaatcgactcccgatgttattagaactcaaatcgataacacgccgagtatcattattttcactagagtaacttgacatggcttgaaaattcagctcttattcctttcttgaaacaggctcaagtaacttccccttttcaagttgtgaatagagaatatttctttggattaggactgatgagaatcagaaagtgctatgctctaaatggccactctcggaaatggctaatgaaacgtctaaatatggaatagtagagttctaagttctaattaaagatttcaaatccgtatctagatctcttattgattaatggaggaacatgtattttcccgattcaaagtctttaaagatcagatcaagtttgtcaccaaaaataattagcacaatgcttgaacattcatcctaggaaataaaaacggattatccatcaatacacacaacattgtttccggaccgtttaagcaaacaactcgaacattgagagcctacaccacttaaaaaatgctgcgtcactttattttccgcactttctgtccgaaatctcatgctaaagaaactaagcttaacaaaaaatgctggttgtcgaaaaaaaatacaaacaaaccctttgaacattgggaatttttaatagattgaacccagcacatttgaaggaaagaaaaccttttaaaaagtttacccggaaattgaacagtttcttttttcttcccatctggatctggaaagttggaaaatttaagattgaacatagtcaaagaagcgatgagatgagatgagatgagatgagatgagatgagttcaatgagctttcacatatataatttcttcaacaccgataagtgctccttttgttttcactgtagaaagagaggttgaaaaggtcttctattcaaatgccggataatcagtttagaatcattgtgggttcttacgaacacaatctattatgtttatctttgaacttatcgttaacccaaccgctattcacgccaatatttcattttcaagcgcactcattgagtgtgaaatgtctagacatatcaaagagatacctagtatcaggatcgaacgatgaaaatataagaatctacgatttacaaaaacgtaaagaattggggacgttgttaggacatcaaggttccattacgaatttgagattctcaagaggtaaagatgccgatggccaggatatccaactcaataaatggctactatctgcatctgaggatcataaaataatagtatggagagtgaaagactgggaaaatttcggaaccttgaagggccatactgccaggatcaacgatttcgatattcatccttcgaacagagttgcagtcagtgtaagtgaagatcattcgatcagattatggaacctcatgactgttaagaaggcaggtgtattgaaactaaggaaatataatcaaaacggacagttcgttagatggtgcggggagaatgggtcgtatattgctgttggtttgttgaacaaattgctaattttcaagaccgaaacagcaaaggtgcatagagaaatcgattttagcaggaatacattgatgcatctagagcgtgaaatcattgatggcgaagagtatattgttgttggattgaacagtggtgccgttcaattctggaaagcatcaaaactttacgaagaagtgccagatgaagaggaagaatcacctaagttggaagctgaattttcactattgggtcacagtaaccgtgtaaaggactttcaattttaccataacaagtttggtcattatttagttacaatcggatctgatggaagaattgtcgtttgggacatgaagactagggatcaagttgcggtatacgattgtggtgaaagattaaattgtgtagctgtatgcgatgaaagtattgaaaaatatgataccgttaagaagagagcaccagaagaagttgaggtgggagaaccaagtgacgtagaagctgatcctgaggaactcaaaaagatcatgcttgggaaaaaggccaagaagagtaaaaagaagggcggaaacaagaaaaggaaggtcgaagttcaattagaatagaatgcttcagtattgttttgtatatatatatatatatatatatatataactaaggcgaataatatacaaagtctcaatcgcggtctacatcataaaaggaccctttaggattactaacaaccaccttcccagaagatgaggatacgaaatagaaaaaaaaaggttcagcttctatagcttagatgttctaccaaccttagcagcgaacttttcatataggtttctagccttgacccacacagaagcagtagctctttgaggtaactgctccaaggatggtaatagatcacgagagaaagattctgaggcttcctttggtaacaatgaaggcaaatgatcaatagaacacacggacaattttggaccaacagtggttggaacttgtactgttggtgcatcaaacgtagtgttgatggtgtaaattggaacagggttatgaggattagtggtatcagcagaaacgtcaacaacagttctcaatcttctggttggcttattcaatagttcattgttgatgaaaggaggaataggctttgataagtatatacagttgatgaaaacatcggcatcggcgatttcttggaagggaccaccacgagcagtctccttcatatcccatttgatgatattttcttctggcaatccacacttacgtagtaaatcagcagcaccagaaccacatctacccaaggcaccaataatcaaaaccttaggctttctggcacctctcttcaaagctaattggtagtctctgcgaacatccttgatcatagcttcttcgttttcgtatggttcaatagctcccaaattctcagaatctgagtgggtttgcttgaaagcccagtctctgataccgactgctgcgccggcaaaaccagcatagaacccaaatgcagctactcttctaccttggtcattttccaagaattcaaggtcgtacaaaacaccattacctctcttgaaacggctcaaaacatcttcccaaccagcttggttcttgtaacaatgagcaaactggatgtgttcgtgaactaacgggaaagtatcagtctctggcatttctttcaagccaatgataatacgatcgcgtggagcggtcttccaagatccttctggaacaatagtggcaccgaccttcttatattcttcgatatcaaaggcagattgggaactctcttcaacgaaaatcttgaaccctttatccaacaacttcttggtagtagttggtgtcaaggctgtacgagcctctaagggcttagtttctgctcttaaatgtagtgtaacactcattgttaaaattgtaattgtctctttgtttctcggatgttctcagtactatatcaaagtaaaatatcgatgagatgaagtcaagcagtattgtttccgtttttcttgatttatatagttacactgttcaagatcatgcaaagattaacaagggtaaatgaaaagtgaactcgagatttattcctgttgtctttatataagttcgatacaatcaattttttgactcatataagtcatctcatgcgctcttcatcaattgtttcaatactctgataaatctcccatcagtttctcacttaaatgcctgtattccaaaggaatttcattgaattccagtgctaatgccagcttttggagtctgaaatgagcagggaactttcaggcaaaacgaatcactactcgactcaaagggaatcttaagattgaaattccaccggaatttcaaaaattgggattcttcaggacagcgccccgaaagttttctgacagccagaaaagatatttttggggtcaatactgtttacttaggtattaatattacgagacacaaacaaacaataataaaaataaaacagttaactagatgacaggatgagaagatgttttggtgggatattgtacactataatccgatacttaccgataagagcttaaattacaacaagtacttgtgcatttatcttgtttttgttccaaaagaggtagatttctttatttcttaacagtgggtggttgtgggaaatctcagagatcattgtagttatatgtcttcttcacatgatacaccatcgcatgtgcagtccacactagctatttcaccgttggtgcaaagaacaggtgctaacagaggtagtatgaataggaatgatccaatagggaattctcaaggaaggaacgttgaaggtgggcgaagcaacataccgcagatcgcacagactccgcatcaagatagaagtcctttagtgcagaagataagagatgtatcccatttagcaactcctgccgttatgaggcacaatggtactgcaggatctagtctattagcgtcgatgacaaagaatggattatttggaccggcactgccgtctactttaagaaaaactagtacatcgacggacactgttgagctaaacaattctacgaatgacgaagatatagaccatgccagcgataatgtattcgatgttagcgatctttcatctgtagagaaactacggctttggaggcacgatgccttgatgcaacaccattataaaactgccgaacacatcggtgatctcatctattcaatgacaaaggatcccaacgatgccttttggttggcacaagtgtattacaatcaaggatcttacgtgcgagccgtggaactaatatttacggatcaattggattcggaaagcataatgtgccgctacttggcagcattatgtcttttcaaattaaacaaacttgaagaggcacttgatatcatcggagacacgaacccgtttcaaagtgaaccgtcctctccagggaatgcagatggtggtgtaaagctcgaatcgtcaatgtgtttgttaagaggcagaatatacgtctcccttagtaacatggaacaggccaaagaatgctttaaagaagcagtgcaagttgacgttaaaaattacgaggcatttgattacttactttcgaaacatatgcttaccactgcagagcaatgggatttggtacgaagcttgcaatttgatgatcttgatgataatgaagagatgatgagatgtctgtacatctcaagactgtccaagtaccaacaccagacggaaattgaacatgctcgtaaagttctctctgataagtattatttgaaagataatcggactgtcttgttggctgagatagaacttttgaataaccaatccaagtttactcagtgtatgaaattatgtgaacaagttctcgaagtcgatgagtataaccttgaagttctaccaatctatatacaatgtttgcattcgttcgcagccaagaacaaattgtttctcctttcacacaaattggcagaaaacttccccaaatcaccagtgacatggttcgcagttgctacctactacctttgtatggggaaagtttcagaagcaaggaaatatttttctcgttcttcaataatggatccaagttttgggtactcttggcttggttttgctcatacttacgtcgctgagggagaacatgaacaagcattatcagcatattccactgctgctagatttttccctggaacacatctaccacatctttatctcggaatgcaatacaatagaatggatgacctatctcttgccgaagaatatttcatgatggcatatgacatgtgccccactgatcccctattacttaatgagttgggtgtcatatatttcaagaggcaaaactacatcaaagctaagaagtacatgaaacgtgcacacgatgcaataaagaatatgaaatcagaaagtaaagcttggatatcgattgtgataaatttgggtcacacttacaggaaacttggtgaggacgaaagagccatcaaatgctttaagaccgtattagagagtagtaaacctactgccactttatggtgttccttagggtttctatatttaagaatgaaaaaaattgaaaaggcaatcgatagttttcataaagctctagcgctggaccaaggtaaccaggcatcaaataaactattgaagactgccttagagatcaatgcacatatgataattgatgagaatcaccctatggtaatttcatcgaacattcaaaatattccgacgtcacatgtatcaaagaatgataagaaaagaacatcattgggaattactagttttgatcccgtcaccgaggcaaaacggttaaaacaaggtatttcagatcacgagggcgattcaatggacattgaacaataaaagtaacatttatattcttgcatatatagcttaataggaaaagctcgcagttggaaaataacttgctagctttttcaagctgtcactctatgcctgcgtccccacaggatctttggactctatgttctttctatggctcttggattttctttttttccctcccgtggatcttccttttctctctggctcctttgaatctaaggattttccagattctatggcattctctggcgctgccaaatcactatcctggtgcgaagcctttggtttgttcttcaatttgtccttcgatttagatttagattttgagtttgctttgggaaccacaactttttctgatccacgtagtaattcaaaaccctctttttcagttttgttacacagggttttggtaaaatcagaagtatttgcttcggtagttgggtggtcattaatagctcgttgaagttcctttaaactttctttacttttattaatttgaagttctttcttaatcagttccttcatgcgtttgctaccttgattttttgaatcttttggcgatagtttcccggaactaccaggagtttctggaaaattttcatcagtttcttcgcttccagctttagtttcacccgaagcctctttagccacacgacgttgttctctcttctcttttctttgtttttttctttggtttatcgttgatctgagatcattcttaacattattttcatcttcgtctgtggtagacgattgcattgttctgaggttgcttttttgctttcttgctaatttagagcttctagttgagttatgctcgctttcatcaatggctaaggaatctgcatttctagtatagtgagattcagatattgtggaagatgaaaatataccagattccaagagacctgtgctctgagcaataccagctctaagattgggtagaggttcattgcttcgtagttttctatcagatttctctttggcttttgatttgcctctctttttggactttgtttcctgttttgaagccttctcaggaaccactttagcaggagttttattcttgcccccaattgaaagagaagactccaaaatccgagctatatcatcctcccataattctccaaattgaagttccttttttaatgctttcgactttttagcactcggtactttacaagtattagcggtcgttgtctttggaccaacgttggaaaacgttggtaagtgtaccaaacagtgtggaacttcctcgactaaaccaacttccgagacggtattctcttctaacaagaagtcaagtaatgaagattcagtaaacaaatccatggaaaattgtgcctcgtgctgtggtatctaccaactgtaatgatagatggtttttatgtcaatgaatagaaaaccttcaaataacaacgaataaagaaaaaaagaaagtagcaatgcctggtttgctgaatatatttaacaacctagtttcatgctaatctctaaatatgattaaagctaaggaaatgtccatgctgcatcagttaagtagcctttgcatgcactttaagccatattttctacaattcacgaaataaggaaatgaacgttttcgtttttcattttggatgttatgtaatgtgacagaaagtgagatattgattatagttagctatataaacaggatagtgagatgatataaatcgaggattgatcataaagttcatttggaaattttgtctttgatagcttcagtgacatgttgataaacttcgtcaacaggttggttacagctaactttgacaactttattttgcttttcgaaatattcaacgacaggaacacttgtttcgacgaaggttttgaatctcttttgaatggattcgatgttatcatcgattcttccactagttttccctctttgtagaagtctttcaagcatgattttctctggacaatcgaagaataaagtcatagtacttggaacaatttcttcttcgaaagtgatggcttgatccatctttcttgggaatccatcaaccaagaatttcttgttactagagttgtaattagaagtgatagcatttttcaatagagctacagtgacttcttgtggtacgatttcaccatcttttatgcattttttgatcaattcaccgtattgagaaccttcacgagcttgctcggcacgtaagagatcacctgctgataagtggacgaatccgaaatcttttaccaatttggcacattgagtacctttaccggcaccaggaccaccaagcacaaagacaaccaatacatcgtccttgctgaaggcaggtgtcttcttcttatcatcagaaactggtccctcttcaaatgctaccggtgggttcttttgataacttaacgaaacaacactagaacccaatgccaatagacctaaaatgagaagtagtttacccttaccaccattgttaccgcctttgctatcggatgcactcgtagcagtggcagaagccttttgagagtatgattggatttgaccggcattgattagccctctgcatacggaagatctcaaaacataattttgaactggagaatatctcaatagtacagatcttgaagtaggaataaaggaacgtaacatcttttcccttgtttatttatattaatatgtgaggcctggcttggctggtatctggaacagcgaaaataccgacatgtctttgatattaacgttatgtattcttgtaaactgaacctggtttcgctctctgttcgacgctctttcaatttttcgtttctttaggtcgcatagaatcacgtgatatggatcattgaagcagtaggttccaggaatcaaggtaggtgcagttcggatccagaaagtagaacaagctgtgccgtggtgttttgccaagagctaatagttgttacgtagatggtatcataaattgaaatgaattacttaacgacggttgttattaataaaataaacaacagctctcaatctatgttataagagacgcacagaaaaatcgtttgcaatgaacactggcagcgagatagattcactccgagaaacttctcaatttttcgtcgttgtatcttaggtaagcgccatccaattcagaaggaatccctttggaagctaaattggcataaatggtaccgggaacgcttggaggtaacaattggtcattgtcatgtaaatcaacaaaccgttgcagggcttcctttgtcataccactaggtccaaaggtttctctgatatcctcttgcattttggttttcacgacaccaggcgcaactgagattgctttaacagctggctcttctgctgcaattgtggcagcaaagtggttcaatgctgccttagaagctccatatgcaccccatccgtactgatcatatattttccacattaccttggaagcaggtagagttttgggaactattttggttagtaaatcgggttctgccgtatgccaatccggcttttcttcgttttagaatgaaatttaagggtatacatacgtatgactttgtactggcacctgagctgacaagtacgatgttaccgttactctgtttcaacaagggcaatgcgtggccgaccaaggaaacaacactgaagaaattgatatcaaacaactgtttccacttggaaatatgtatattattaacatcttccacaggatccaaaactcccgcattggcaacaataccatctagtctcttgtatttcgactcaatgaaattgacagcttcagttatagtttcttcatcagacacgtcaccacaaatgtaatcaaacttcccactgtattgagttttcagctcctcaagtttatcctttgatcttgcaattcctattacgattttagtcgtctcaatagaacataacttctccacaatggaagaaccaattcctctagaaacacctgtcactaaaaacacctttgacatttcaattataatggatctacgatggcttaaactagtgctgttattaatacctatcttcttacaatgtcacactttccttctcgttcatggtacaaaggttagaaattgcgattagaaagtttatatagttaacggtttttcataatgtatgtaaataacgtacatgggcattttcacgttattataaccggaggattattgtgggattatagcggatagagagttccatatatacttgagattatcaagatacacgaccacgcatgatcagttcagcatcaggcactaactggaaccggcctgattccttcaaaggaacccagtgtagaaatattatcattcatggatattgtaagtttgaaaacgaaggatgccaatttaatcatggaaacagcaaagaaacagagggtcaaacaacggacgaggtcccaacgcagcgctcaatgactccgcttaacgtgaagttcaatgctaagacaagttctagttttacgccaggaaaatctccagctgtaaggagtccagacttctcttcgcttcctgcatttcagccaggtgcaccagtcaatgatcaaccaatgttggcagatgggccacagatcagtggaacgatgagtcctagccttatgaactcgaatgcaacggcgtttgctccgtcattcaatccgtatgcctcagagagttttactccatcagtgtcagcaggtggtatcccttcctcacaggaactggcagggacactacatggctccaacccgtctatcccatcacctgtgccttcgaatccttatgtgaatagtgcgggtttgccctcaggcggcatgctaggagttggtcatcccatgcaaggattacctccaccaccaccacccggtgcattaccagtaaatcctatcactcagtttccaacagtgtacccaccaacacattctgtattgcaatatcacttatatgctccagatccaccaccacacctgaaaataccgcttaaaccaaacgagcgaactcccgaaactttgttcattaacaaccatttgagggatagattagtcaaaaacaatcaaactgcgcttcaggtgttccctagaggttccttaccggatatcgttggtgattactttggattggtccccatggatttccataatagaacatctgataagaaaaggtacaatggtcacaagaattccttgtacaaggtgttttcaaatcttgacggtaagatttatttcatgcgccgtattcatgacgtcaaaataactgattctgcccaagtgtctaaacctttccaaacttggagtcacctgcgttcggcaaatatcactgttttgaaagattcgtttgtaacgtctgcgttcaatgatagctcgttgtgtatggtgtttgattactaccctcaatcacaatcgttgtacgaaacttatgggcttgccaattcagttaacgaattaaatcaagagtacttatgggcatttttggtacaattgacaattgcacttcaagaagtccattctaatggactagctcttaatgatttagactggaaaaaagttatcgtaactggtgaaccaggtagaataaaagtaactgatatcggtgtctatgacacgctaaattaccatcaagaggggagaatgttacatacagaacagcaacagaattacttatcacttgccgagttattattaaaccttgttcaaaggctatgcggtgcatcaggcccattagacgacgtaaagtcctaccacatagatcctttattcaagaaatgtattcaatacctccaggatacatcaaacaacaacaaaaatatagaggacttcaccaaacttttcagccataaagttctttcagtggtaaattcgttacaatacaatagcgaatacctagagcagcaactttcacgtgaattagaaaatgcaagattattccgtttgatgtgcaaactaaatgcaatttacggtaggttagaatcacgtatcgacattaattgggcagagtctggagaaaagtttccgatcatactatttttcgactatgtgtttcaccagaaagatgacactggcaaaaatgttatggatttgacacatgtcttgagatgtttgaacaaactagatgcaggcgtatcagaaagattaatgcttgtgacgccagacgagatgaactgcatcataataagttataaagagctaaaggatttgatcgattcaacattcagagcgctaacacaataatgtaaacataaactaaaattatataacaaacccaccaaaaacagctgaaaaaacttacatatactactacccacttttcttccgatttgctcttgcttcccaaaggaaagtttaatagatagaactttacaccttattgcgtctgcacatcacgtgtaacggcactgctttcctacctgaacgtcaacttcccaagttcgttgggacttactgatgtaaaatcttgtaatcctgacatcagacctcaacgacgtctttaacaacggtcttttccgacattcagatttcagaaccgtaaacacatttcttatctaaaaacgaaaagctaaacaatgcacacaagaaagtaagagtaaatacgcacacaacgcgaaacaagcatcgattcgatacgccttcatgagcttcggagtagacccactatggtaaacatttcggtctagtgtttgtcactaaacatagcggtaatgttaccttgcgtgttagttcgtcggacatctgcgcaaatttgcacacaattgcgacatatgtatttttgcactatttctttatacaaaaaaaaacgtacaacaaatatagataagcttcggtttacaaagcgatttattattccccttatgaaagtagctgcactgtttgaaatacagcgaaccgaaacacgaatacagtgcagcaaattcccctatagcagtatggtgggctccattgccttatgaaccaagctatccttactggcctgacggatataccccaagtgtatcctgtagtgccatgttctaaggtatgcagatttccgcatcttagcgcctaattattatttgtattttgtttagaacgattgggcattttgtttgtggtttagataagggaaattatcttccatacaaaaatgtcatttccgttagcgtatatgaaaaaaaacatggatcgcagataaaagttaagataagccattccattctcttctatgccatttacagtgttatcctcaaagttagaattcggatacaaacgacagttctcgtacttgttattggcaagcgaaacttcaatggctaggtgaagagaaagtatataaactgctcagttatggaattaataaagtagcagaggttcatgagatgttagatctcgtttaattccgaagtgtcaattttactacggttataatatagttcctaataaaccaagtgtaattcagtaaagtaagaatcttacgccacaagttgtaccttgtgctcttctttactatatacacatttattaatatttcaaatacaagttgttaaagccaaaattgcaataagatggagtccactttaggttggtcagtccaagattggttgagtttccattccaaatcaaccccaactaagtcattagaattgcttgaaaacttgttgaagtcccaaaagccagcaccagaggaccctgcttggatttctttaatccctgtggaagatcttcatcatcaatggaatatcttacagtcaaaatccaacaaagaagaattacctctttatggtgttccaattgcggtgaaggataacatcgattacaaaggattacctactactgcagcttgtccttcatatttatatcaaccaacaagagattcatatgtagtcgaattgttgagggatgcaggtgccgtcgtgataggtaagaccaatttggatcaattcgctactggtttagttggtaccaggtcaccatatggcaaaacaccatgtgttttcaacgataaatacgtaagtggtggatcatctgccggatctgcttctgttgttggccgtggtatagtgccattatctttaggtactgatactgcaggctccggtagagtaccagctgcattgaacaatttgatcggtttgaaacctactaaaggtgctttctcttgtagaggtgtggtaccagcctgtaaatctttagactgtgtttcagtgtttgcattgaatttgagcgatgcagaaattgcattcaaagttatgaacaaaccagatttactagaagatgagtactcaagagaattccctaagaatcctatttctcaatacccaaaggatttgacaattgcaattccaaaagaggtaccttggtttggtgaaacagagaatccaaaattatacaccaaggctgtggcaagtctgaaaaatactggtgctaagatcgtggtagtcgattttgaaccactattggaactagcacgttgtctatacgaaggtgcatgggtagcagaacgttactgtgctactagggatttcttagccactaatccaccagaatcatcacttgatgaaactgtcgtgaatatcatcaaaggtgcagtgaaattcgatgccgctgatgcattcaaatttgaatacaagagacaaggtatcttacaaaaagttaatttattattgaaagacattgatgttttatgtgttccgacctgtccgttgaatcccaaactagaagaagttgcacaagaacccgtacttgtgaattcaagacagggtacatggacaaatttcgtcaacctagcagacctagctgctttagcagttccttctggtttcagatcagatggtttaccaaatggtatcactttgataggtaaaaagttctcggactatgctcttttagatttggctaagaggttcttctcagttgcattccctaataactcaagaacgtatggtaagtttgtcgatagaagaattaccgttgaagatgaattagatggtccttctaaagatactttgaatggtgtcaaactagcagtcgttggcgcacacttgaaaggcctgccattgcactggcaattacaaaagtgcaacgcaacatacctctcatctccgaaaacttcaaataactacaaattatatgccttgccaaaagttggacctgttctaaaaccaggtcttagacgagtcaacgatggaacaggatcacaaattcaacttgaagtttattctgtaccatatgatagatttggagattttattgccatggtacctgaacctttgggtattggttctgtcgaactagaatcaggtgaatgggtaaaatccttcatatgcgaggagttcggttacactcaacaaggaacagttgatatcacaaagttcggcggattcaaaccatacattgagcatattcaggtaactgaagctcaaaagaagaaaccattcgaaactgttttgatcgccaacagaggagaaattgcagttcgtatcatgaaaaccctaaaaaggatgggtattaaatcggtggcggtttactctgaccctgataaatactcgcaacatgttactgatgcagatttttctgtggcactgcatggtagaacagcagcagaaacatatttggatattgataagatcatcaacgccgcaaagaagactggcgcacaagctatcattcctggttatggattcctatctgaaaatgctgatttctcggatagatgtagtcaagagaacattgtgtttgtaggaccttctggtgatgccattaggaaacttggtttgaagcattctgccagagaaattgccgaacgcgctaaagtgcctttggttcctggatctggccttatcaaggatgcaaaggaagccaaagaagtcgccaaaaaactagaataccctgttatggtaaaatctaccgcaggtggtggtggtatcggtttacaaaaggttgatagtgaggatgacatcgaacgggtatttgagactgtccaacaccaaggtaaatcatatttcggtgacgctggtgttttcatggaacgttttgtgaacaatgcaagacacgttgaaatccagatgatgggggatggttttggtaaggccattgcaattggggaacgtgactgttctttacagcgtcgtaatcaaaaagtcattgaagagactcccgcaccaaatttacctgaagcaaccagagctaaaatgagagcggcctcggaacgtttaggatctctattaaagtataaatgtgctggtaccgtcgagtttatttatgatgaacaacgagatgaattttacttcctagaagtgaacgccagattacaggtcgagcatccgattaccgaaatggtgaccggcttagatttggtggaatggatgttgagaatagcagcaaatgactctccagattttgataataccaagatcgaggtttcaggtgcatcaattgaagctcgtctatatgctgaaaatccagtaaaagattttagaccatctcctggtcaattgacttctgtctcatttccatcatgggcaagagttgacacttgggtaaagaaaggtactaatgtgtcagccgaatatgatccaacactagctaagattattgttcacgggaaggaccgtaacgatgccatcatgaagttaaatcaagctttaaatgaaactgctgtttacggatgtattacgaatatcgattacttgagatctattgcatcgtcaaaaatgttcaaagaagcaaaggttgctacgaaggttttggattcttttgattataagccatgcgcatttgaagtgttggcacctggtgcgaacacttctgttcaggattatccagggagaacaggatactggagaatcggtgttcctccatcaggtccaatggattcttattcttttagattggctaatagggttgttggcaataactcaaaatcccctgctcttgaaatcactttgaatggtccaaagctattattccacacggaaactgtgattgccgtatctggtggtactgtctcttgtacattaaacgacgctcaaattgcacagaatgaaccaatagaagttaaacgcggtgatattttgtcagttggaaaagtcactgtgggatgcagagcgtatttgtcaataagaggagggattgatgttcctgaatatcttggctcaagatcaacgtttgcaatgggaaacatgggaggttacaatggaagaattttgaaactaggtgacgttctattcttaaaccaaccagagttatctgtttcctcattaccagctcccgatttcgaaccgcaagcagctccgaagtcattattgccaacgctttcgacgaataaagactggaaaattggtgtcacatgtggtcctcatggatccattgaccttttcaaagaagaatacattgagcaattctttaacgacaaatggaaagttcattataactccaacagatttggtgtcagattaattgggcctaaacctaaatgggcaagatcggatggtggtgaagcaggtttacatccatctaacgcgcatgattatgtgtattctttaggtgcgatcaattttactggtgacgaacctgttattattacttgtgatggaccgtcattaggagggtttgtgtgtcaagccgttgtggctgaagctgaactgtggaaagttggtcaactgactccaggtgatactattcagtttgtaccactttcctatggcgttgcaaggcagttaaaagagtcacaagacaagtccattgacaattttgaagaaggatctttacttgaattatctgatgacaagatcctaccaaagtatgaaaatcctatcttggctgttttacctaagaagagcgacctttcacctaaagttacttatcgtcaagctggtgacagatatattttagtggaatacggtgaattggaatttgacttgaatatttgttacaggatcaatcgtttgattcatcaagttgaaagacaccagacagtcggtattgttgaaatgtcacagggtgtaagatctgttttgatcgagtttgatggctccaaaataaatcaaaaggcgttattgaagtgcttgattgcttatgaatcagaaattcaatttgataagaactggaacgtgaaatcaaagatattcaagttgcctatggcgttcgaggactctaaaactttggactgtgtaactcgttacagagagactattcgttctgaggcaccatggttaccaaataatgttgatttcattgctgatgtcaatgatattgacagaaacgatgttaagaacatgctctactctgcaaaattcatggttttgggattgggagatgtgtttttgggttcgccatgtgcagttccattggaccctcgtcacagatatcttggtacgaaatacaatccatcgagaacttataccgctagaggtgtcgtggggattggtgggatgtatatgtgtatctataacgctgaaggctccccaggtggttaccagttggtaggtagaacaataactgcctgggataaactagttatcggcgatcatcctattgaccatccatggctcttgactccatttgatcaagtcgaattctatccggtaacggaggaagaacttgaagtaattatcgaagataacgataatgggaaattcaaaatagatgttgaagaatccatttttgatcacaaggaatatttagcctggataaatgaaaacatcgattctatcgttgcattccaagaagctcaaggcggcgaaaaggcagatgaattcgctagattgattcaagttgctaatgctgaattgaaaaaaagtggcgatgacaaacctcaagatgttgaagaatatcctgatgatgccgaattgctatattctgaatatacaggtaggttctggaaaccagtggcagcagttggtgatcatgtagaggcaggagacggtgtcattataattgaagcaatgaaaactgaaatggttgtcggtgctactaaatctggtaaagtctacaagatccttcacaagaacggtgacatggttgaagccggtgaccttgttgcagtgattgtctaaaccgatatcttaacttccgccgacaaaaaaaaactactgtcgaggggaaaagatgatgtgatgctttctgaactatataatatttataaacttgttgtattgtaatgttatgatgtattaagattatatgtcagtacgtgggttagttaggaaagaaaataatgtacatttatcaagagatctatcaatcactgttttcgtcttcctcatcacttctaacatcttcggcacctatacctttgataactttcacaagaactttcaggataagatacatccaaatgcaagtgatgacttgtagaccaccgagcaatgcaaggaaaatgttaacgacagtcggcgtccaacatcttttctgtgctaaacctgcaatacactcgccatctgccattaaatttttagctcttagccaagtctggtaagtgagataattgtaaacaacgtgtcttaacataacccaccaaaatagaaatacaacaaacatataatcacataaagtactgtatccgcagtatttcagcatcttagcaaaggacaacagcacatccactatatccattaagattaaaatgacattcccgattcttgtgaaataataataatatgaaccagtagtcaatgctacagtaataatatgatgagcgaacatttgccaaaaatccttacgtctttcttccacatttaagacaatgatttgatggaaccaagatgcaatttggaacaaataataggtcttgaacaaacctgataattggtcatggggccagccgctataaatatgatcgatgttgaagtaatatggagaatgataatacagatagaatccaaatatccatgaaaacaaatagtaaatcatggaccacccttgctctccgaatctttgaagagattttacagatctcatgtgaaatctatttctacccactggtttcaaaacaaactccaacaagaacgatctcaccaaacagaacacaacaatgaaagttaagataacgtagccatcgtctattccaatatcatacttcccaggattatcaggatattcatactgtagattaacaaacttcttagtgtactccggataaaacgagttcccaacaaacaaaagcgacaaaagaatcgaggacaacagcacagaatatcgatccactttggaaactggcttgaagtggtgcttggaactagaacctgtcctagaacgtgaacgagcttgctttttctcatcaaaacgatgctccgtcaatgacggagctgcactcccagaagaatgtctttgcctcaattcagaagacatttataaacctaggatatcgaattgaagccagcaaagcgtttaagcaataaaaaagaaaacaattgccagagttgataatagtgatgcaaatatcaacactcttggcaaacaaaaaaaaattcccgagatggtatcctaactaatatacaatgcgggaacctcacagaataatgaaatgacagacactctgcttctgcttcactaaacttttggactcgctttcttttgaacttgtgcttccacttttcctacttctactctttataaatacacgttaacattgttagttaagatttgatttcgagtttcatgtttaactctcgaaatcatattgccgttcgttcacttttttttttcttttctgcgcatgaatagctctagattatttggcagatatcgcttcgccaaagatatttttggtgttaaagagaaatagaagttgcaaatgcagctcttggagtgaggcttctacttgtcctctagttgactgtgattgcgaactaaattttttttgtgcgtacaatgtgtatatttctcagtgtctgcatttctgtgattcttccgtgagttgtccaatataatttcatttcgttcttatgcgatatatccttgatgcgtggttgatcttgaatgctacgtaatttgttatgtatgtacaggtgtgaactgaacgaaatcttttcggcttcagaatcactgaattgctggtgtttgttgacggaggtataactcgtgtaggagcgctctgatccgcagttcattgtatttgtcccaatggtcgtatagtgatatgagttcttgaaggataaacatcacttgttccaaattaacttgagtttcagcgatgaacatgttgatgttagcacgctttgtactgtcctctggcttgtgaatgatgcaagacactgcaaatagacaacttatggcgatcacgtgcggtgaatagagtaaatggacatcggtcgtataactatcgttaatcaacgaccatattttctgaagctcatcgtctgagagtttatagttgtacttttcggatgataatgccttctcgatctgttctagagaccggtacggatggtgtacaatcaaatatgattgcaattcctcgattaaataaaactcaaactcggtcacttttgtcacatccggtggaataaactctggccatagagacctcgcctcgttgactagcgttcttatatgctgcggacattcttccactttgcaagccaaatagatgcaggtggtgattaaaagatacaggttcacttccctgacactagctcgaagcaaaaatcggctcaaataaacatgtgctgtaacaagtgcacactgccgtatattgagcctcctgcccaacttcattataaggaaatagcagtatatcctcaaattgtagtctcgatcataatgcagatctcgctgtgtaaccggaatgtttgtcgtcacctgcttgttcgccttcgaatcgtgaatcgtaacattcaaaccttgtgggaataattggcattccaacagccagagtttctgcttctccttagccaaggattccctagtatacttccacttgtgcctctgactcgaatcccagtatgaggcgctcattttggaaagataatcttctagctgttcaatgaataagggggggaaaggtattttttatcctccagtgaaatttgtactgccttttgttgtcggaatcctttgttcaaagtacctaacccgattcggttcttactaccttaccgttcgctattcttcaattcatcatcaagtacattatgataagctgaccgttgcagccctaaatttcaggtcgttaagaagtcgggtaacctttttgaaaattttttggaaaaaagttaaacattcaactatatgaaccaaacatcagcacttcaaacacttacttttaattaaatgttttctagtgttgtcttttgttgttgtttgtttcgtaagtcgagggttttgtagtcgaagaatcgtcactgatcgaagcttacataaggaacggattttatctgttcaattgaaatgatatcatttctatagctttgggtagaaagtctccgaccagtccgtaagcggaaacgtaatgagatttaaaaacttttcaaatgtttaaatcaactcattaatcgtgttggttttctgtcacggtttctatccagaggctgttttagaagcctctgtgtcttgggtactgaagtatttctttactttaaacgaaagttatgacgattgcccgagcgtttttatctctttttttgttacttctgtttacaggggtgattagggaggaggtagcttgggtaacccaatggagcttactttctcggctcacgaaactctccatccttttttcaatcatcaaacagcttgaagtggattcgtttcaaatttattttgaacttttcgatacttacgcatagtcaaatatgccaagctgccctgattatttattattgtatcatttattgccttggattatactcagttgagtatcctctcatatcaagtgctacaaggaagaatttcaaaagatccagccgtcatctttccctcttcattttaggatttttaacgtgatgaaataacaatgcaacatagagtcaagctctgagcttatatagcatggacgagacttgctttttacaaacgtactgatcaaatttccttgatgataaagaagagttattgactgcggtctagagtagtactgtatgtatcttctctgttttgattttttcttgaacgctgttagcaccgcaccatctagtatgagtccggctaaccatttgctatgagttgtaaacatgtgtagtactagaatcatctacttgttagtgtggttttcccatcgagtaagtatctcttgtatttctttgctttccatttacggaactactacctaccatttctatctatcagctgaactacataacgtggcacaaaaagtgatcttcctatccatatctaactttgtctcaagctgctcacctctaatgttacatagctatcttctatttctgccctggagtaaaagaggctttttatttctgatcgtgaactgatcatcagatggttttctacttgttactacccataagttctaatgcataaatcaacatggttgaataaatgttgcaccaattccaaaaggaccatgaatcaaccacgatctttggctctgtttcgtatgggaaacatccccatatacagagatcatttttcaattgaccgctataccgtagaatcaaatgcgtgtacattgcaataatgatgcatggtgaataccagtacacaaaattcattattcttctgaaacttctacgttcttttgtatttctctgcaatgtcggtataatacgtgttgcactgtaaaatatcagtagtctgaacactaaatttattacaactgctggtattagactttctttggccatcttgaatgtcacaacgaatatttcttggatacttatcggtacgcttttagtgaaattcttcactgagttccacaaaggatttagaatccatttacattggtccatcattttaatatatttatggttccgaggcgtgtgttctactatctgactccagatggcgcgataatttttagtcatgagttccaaaagattatccttcttgggcaaattagcctgatggattttccatgtttccttaacgatatcgaatatttcgtccatggcattcatcgccatcttaggacttatttcgtaaacattgcgaaccatataagcaaaaaacaacgagctttccatcactgaccctgatccgtttataccatataatccgataccacaaacaattgagaatgtgaacccaagtagtgaagcacttggtgtggagagttcccacattggagtgacatatattctgtaaaagtaaaatagtgatagcgtaataattcccccactgatcaacaaactcagaataacccattgattacttcttctagacatcttgagccatctctctgtctcccctatggcttgaatggcgagaatggtgaaaacaccctccagtagagtgaacactggagtcgaatgtatcaatgatagctgccatggcttcaccatcacattccaaaatactttgaagtactcggaatcgacagtatcagagtcgatgttttcaaagtatgacaaaaacatgaataaaattgaaggaatgagaagatgctgcaaataataaatcagggttgacaacgctgatccgcggtccagtaatactagcttgaaagtcgttgaaacaaaatacagagcaaataacgttacagtaaatgacaatccacagttcagcccaccaacttggaaacttatcggaatggtaatcagcacgagaaatagatacattgtcgtgagaaatatccgcagagtttgaagcacactcttctttattagtggcatcttggaaacgttgaattttgcacagtgacgggctattgttgatggctcaagccttctttcttgactccttcgtcttctggtttgcttgaagatttccatcgtaattctatgtaacattattttttttgtttgtattatataagtttatgaaaacagtcagtttacaggcgcagtagtaaaaggaatggaacgtaccaaaaaggtaaacagtatgacgagcacactactttgaacttgtttaatcgcttctcaaggtagacgtaatctttgaggtgtttcaggtctgctgtgacatgactttacggtaggaaggggtcgacacttcttttcaagtacctggacctgatgagatcattaaacacggatgaaaaattgagcatctaagattataagatgcgatgagatgacatgagatgagcagtatattaaattgacatcatattaattgtatttggttattgctggagtagtagaaaagtgtcatttatttggtaaaggaatcctcaaacatgagtaaaatcagagctggtccaaaatctggtagaaaacagttgagagagatcactagagctggtcagaaaagagtaagatatgatgacgaagcaacggtagcagacttaacccctgataatgaaagtgattctgataatgcagagccatctgttgcagctgaaagagaagatgttgagcaacatagaggacaagcttataatgcgttgttaactttattaaagtcagaacatccagaaaggaaacacaaatcaaataagaagatcaagaaagattcccaacgcgctgaggaagacagtcctgaaaacgatggaattaatagtgaagatgaacaacaaaatattgaaaatgctttggatgatgtttctggaggagttgtggatgaggaagatatggaagattcattatctgacgttgatgagagcgaagatgaatccgatccattcgaatcacatttcagcaaatatagtgaatcacgcttatatgctttcgataaaggcttcaaagacaagactgtcaaatacaaatcttcgaaaacagatgtttcggaagaagaatctctaatatattccaaaccgtgtctagatgatgaggaagttttgcctgtgaaggggaaacaaactttgagctcatatttcatcaaacagaagttgaaattagcaaacgatttccaaaacaatggcttaccgttaactgaaattcaaaaggaacttgtagatccaatgtttcagtataaagatatgttatacgaatacgatgattatgctgatgaagatcaatacagagatctgtattctttacatgcgctcaaccacgtctataagaccagggatcgtattttgaaaaataatcaaaaattacaggaaaacaatgatgaagagctattggatcaaggttttacacgtccgaaagtacttattgtagtaccaacaagagatgctgctcacaaaattgtccggaaaattatggagaaatcagggcttgatcaattcgataagaaatcgaaatttgaggatcagttcttcgaagattcgttacctcctacttcaaaacctaaatcctttcagcatattttccagggtaacacaaatgatttcttcgtattgggtctcaagttcactagaaaatccctaaagatatactcaaacttttatcagtccgatatcattatatgctctccgttagggattcaattaattcttgaaaacactgataagaagaaaagacaggatgatttcttgtcgagcattgaagtcatgatcatagatcaattgcattccattgaatatcaaaacgccatgcatgtgacaacaatttttcagcatatcaataaaattccggaacagcaacgggaagcagatttcagtcgaatcagaatgtggtatattaacgaacaggcaaaattcttccgccaaacaatagtcttcactaaatacatatcaccgtttgccaactcaatcttgaatgggaagtgtcgtaatcttgctggaagatggaaaaatcataggaagataaaacctgaacaatcaagcattggtcaattaggactaaaggttagacaaatattccaaagatttgatttagcaggagggacagctctagatgaacctgattacaggtttaaattttttacgagtgtcatcgttccgtctattgtgaaatctactgggtacgaggatggtatattattatacattcctgattataccgatttcatccgtgttagaaactatttgaaagaaaaaactacaatcatattcggagaaatcaacgagtactctaaccagaaacaattgacatccaatagagcaagattccaacacggaaaggtgaaggtcttgttatacacagaaagattgcaccactttagaaggtacgaaataaaaaacgtcaagagtgtaattttctacaagcctccgggaaatcctgaattctattctgaagttgttcgcaatattggtaagaacgtatttttaggcaactgtgatatcaacatttcaactgtcagatgcatatatagtaagatggacggtctttctctagagagagtcgtaggatctaaacgcgcggcagtattggctcatggccaaaacgaagtgtacgagtttaaatagagtggatcaaatatgccataaataattagtaaaccgaaaacttacgcaatcgttctcctttactaatagcttagagtattaaaatatgttgcacttttcaacttctttgtttgttgtagaattttgaaactcaaagtcagattcaaagagtacatattaattcttaattatttgatgcaaagagacaagcccgcaaacgaatccaatagccgcccgataatagattaaactaattttatacttaaaatataattctatagacctcagagccggtcaaacttgctaatgagagctttcacctatagcaattgtgacttatctttatcttttcccttgggtttatcaactgttgaattgcgaaactgccatggcaatgcaagctaaagacacataaggactagctctttccccaattctcgcaaacttccaaaatactcctagtataccgctgtccttataacgatcaaggagcgatggtctttgtgcatgaatatatgtgcacgaacatatgaacaatagtataacttgtaacaatgatttaaaattgaatagggcagacatgtttttcagaaaagctagtgaccgtgaatattctgccgaagaaaatatctactctgaacctttcaaaacaggaacgagatgaaacctaaggttcatcagttatcattccactgtattgaaaagaataaaggaacttacgctccccatacacttagctcttcgatctttaattttggtgaaaaatgtttactcttcacgtgatctaaaaattgaatgcttctacttagaaaaatttgaaaaatctgatcgacgatccaaaatgaaattatagtgaaaagttgaaaagttcacaaatatgctgtatgaacagctccaggacaacaagtattggatcgattgcttgaacctgcgagtttactgagatagtatagagtaaacgggccatataaacgtcagatataaaatgaaggttcagcaagaagccgttaatgtactagaacgtacatccgcctatttgaagtctggtattttgaagaagactccagcttggtacaatgttatagcgaaggtaccaccaacaaagaagtttgctagaaccccacaactgacacatcctatgaacggtaaatctagaactgcactacctgattacagcaattggaaggccaattcttcaggattatacaaaactagaccaaattctttggaaaagaaagatggtgcatcgaagctatatcagtccccaaaattagtatatatcgaggataaattgagaaaattgttcttccagcaacatccatgggaactttcaagacctaagattcttgttgagaataccctagagactcaagaatatgactggtctcatatccaacaactaggcaagccattggatggcgaatcagttgtacaaaggacgcttttcctattaaaatcaggagagaaaaaagaactcattgatgcatatgatcaagctagattcgagttctaccgtctaagaatacaacaagaaattcaagatcaagttgctcaagaagaagccgaaatgttcggttcagtcttccataccacttcaatagaatacggaattgctaaggaacaaaaggtcattgacacatggaagagaaaggccttacagcaagctgagttgatggctgccagagcaagtagtccttctgcttcctggacaaacgagaccgaagaagaacaaaaacctattgatcaagatgttgaggaaattcaactatgatcttccacaattaaacacaaccaatgaacactattcccgtcagaactctgagttttactgtcattattgtataaaaatttcatgtatatataagtcactataactataaagttactcatagttaattcacgaattgaaagtactttcatgagcatcacaaaaagcataaaagatcaaactaaatggggtgtctttgcatttgacaaacgtcagttgtcaccctactactatttttttatttctccctcataagctgaaacaaatgagttctctgtttcaaatatttatcgaagttaataaaatctcgtatctctacaattttaaagttcttcttgatcttttggaagaaatgtttgtccgctttacgccttttcttgtatgccattagaataattggcacattctccccatcagttaattctaacagtgttttttccaataatgggaaagcagcttctaagtacacacagtccgcagctagcactaaatcaaccggtttcttgacaaatacatccggcaagggattcccccaccataacacctcggcgtgaaccttatcatccaatccgttgacttgaatattagattccatgagaccaagcagctgatcaatgtcagaaatataaacttcacgatctgaatattcattcgcttgatccattagaccaacacaaagcccaactagacctgtaccactacccagttccaaaacgctattgcaattcccatctggaaacaaatgacttagcaaatgttccttgtcggatttttcaaggatatattcgcatagcagttcacctgctatccacactttacctccgcatccggattcaccaccatcttcattgattataagaggactcggcagttttccattgaaagacatatcaattttgcccagatgctcaattggcctagctggcactagttcctcaaaacaacttgaaaacggcacatcccccataatgaatgccttacaggtctccaacactgttcgctcttttcgatctctcgtcagcacttctaaaagtgacatcgactgttacataatatggaatttgtctacaggttttctcggaatagtcgtatttttcactctttttttagagtttacagactaaacttcttcatgatgtgaaaaaaaaggacatccaacgacaatatattccatttacaatacgatgtacattgtactgaatctgcaattgaatatgttctctctatagtgtataaataaatgaaggctatgaaacttctgctgaggtgttatgcatgaaaagtctgtagactataggtgcgtcagtttttttatatatgtacttttttggccggctttttctcttatgcttgagacactagggacaaattctcatcaacttgacacatttccacacctgtagccaacatttgatcttgtagtgctgtctttataaacggaatgactttttccatatcacttgcagtgttttttgttatacccgaataattctctgggaaaatcaaaactgagtttaagtctttcaagaagcgatattgaggtgttttcactaaagtatacttcaagaaatcatgcaccagaggttcgatattatctatttggcttgaatcgaacactccggaaatgactattgcattagggccctcgtatggggccggtaaaggtgtctcggatgcggggatattaattaaggttttcgtgacttttgttgagtaatgttcttgcattctttccttttctaatgttttaaatagttgatagagttctgatgcgtccttgagtgttaactccggcttcttagattgtgattggatcttttttaggtaaactgatctatttggttctcgatcttgactttcggagtagagagcgtatgcagatgccaactctttgataaattgacgctgtggtactctcattggtttcaaatgaagacttaatttttgagtgtcctctatgaatttatcaaaaacagcacaaatttgatcacaccagttcacttgttttttgtaaacgttcaagaccaattcagagtaaggcatatttagatcatcaaattttttagcaacaagaacaatggattccagttgctcttttgtatttttgggcttttcattcatcccaaaagcctccatcaattccatatgcctttgcaactttgcacattcttcatcacatggcaatttttcagtttctgatctactttgagtgtcgtgggtagcaccacactcaacctgttttgttcgacgattgcagtcacaagtgatgacgactttttcatggcatactttctccggacatggtgaattaccatgacatttttctttacaaagatgtccacataaacttcttttcaacccgcatggtttggcacatttgatttcgcattctccttcaacatgacatttcttctgacatttgtgatgacatgttgctaatggcagcccacattcggtaccacaggccacctgagagtctggaacaagacacaacgtacgcatatcgtgctttttgtaacatctgcattttttaatcacgttagccgtacaaggaggacagtctgtaccggcaggatgacatttatgaggtccaactctatgtccgcacggagctgggccctcagaaatttttatacaaggatttggacacggaggtagtttggtaccacacctaacaggagctggaacgacagtcttcccgcacgggcataccaaatcatttggatccgattccaagcatggtgggcatttgccaggatggcacttccatgtacaatcatgtatcccacaactcagttttaaattacattgttttaagcagacatgttcaggctctactagagtctcattgttaaggtctcttttcaggaacaaagttttctctcgcttcttagcagctggtttccccgaacaacatatttccatgcatttgtgtcttctacaggacatattcgattcgcatttgatgttacagcgaggggtatcatgaagctgacaaggagtaagaaacgtcttcgagtgacatgtacatggagtctttgtaataattaagcatgggtccatacaatcacctgtatgacatgaaaaaggacacgtatgtttcccgcacgataactgtttcccacatacattggaacatgtcggaatcgtatcagtacatttcctcctgggtttatccagctcttttagcatagtttttccacaaggacatgtcttgagagtcttgggagaaaatggacagggtctcgacctatctatacctgcaggcgcaagacattgctccacgtatgtatggtgatcacaagaataatgtaaagttcgaacctcgccacatgaatacacaccgatccattttttgccactcacatctttagaatagtccaaaactctaagatcggaacattgaatcccagacttaacatcagaaccacaatagcaaggcaattctgtttttattatactttcacagggaccacaaaatccagtatggcaagtcttttggcaagtgtgttttccgcaaggcaaaagtaaaccacaaacatcaccgcaattataggagtttcctagaactttagacctagaacaagggatttgcttacagtgttttccacatttgcatttaatttgcacagggatcaggcactcaggatgtggaccgagatgacaaaccttggaacaaccatgtacgcatgaatatgcattgcaagtttgaccacaggaattaggatctagctcattaacatctggattgacaacttttccacaccaacaggtacttcttttctgttttggaatcttatggttgattttgtaacagttgggacacttccaagacttatctaacgttttgtttgtagattttaaagcccattccctgacacattcgtagtcgaaaactctataacaggaatcacacgcatacatccgacatgtagaatcaagctccactgtacaaatcatgcacacatactgatcaccatctttgatttctttaacggtttgctcatagtaaggaatattggtatcttcatcgttatcactgtcaaaatccgaatcagaggaatagagccttggctcactttctgggtatattagctcttcagcagtcatttctaattcaactgctgcgatcaagtgacgcgtttgatggaatggacgcttatattttagatttaagctaagagtcggtatgacgggatgagatgagatgacttttacatacaaaaacgtgaaaaaaagtgtaaaggcagcaaaagaaaaaagagagaattgtaccaaaatccgtataacctaaaacctgtactgacgacaaaatcccatcgatatcgaactagcaatgctatatgctgcaacatcagatctagaagtcctccttgatgtgtcaacatatatgtttatgtattacgtgaaggcatacggttatctatcgtttagtcacctgactactttcaaaatgctcgaaagggagttttcagtttcccaatgaatcgcagataaattcctgtggaaattcgaaatttcatcaaccagtcattgggatcattgaaagaaatatgagttacaggaaactgaataacctgtaaactataaatacaccccagtgttacgatttggattggattgcagctgtagttgattctgtgaaaaccatcacattttactttgttttaaggttatcgaactacttgtcccgaagatcaagcagcgaattgtttcatttcgctatataacaaccattcaatatgatgagaacacgtttcattcaattgtcccgtcgtgcttacgcttccaatgcgaagaatttaacaattggtttaattccaggtgatggtattggtaaagaagttattcctgctggtaagaagatcttagaatcattgaacccaaagtacggtctatcgtttaaattcattgatttgcaagctggttgggaaaccttccaaaacaccggtaaggcactccctgacgaaaccattgatatcttgaagaaccaatgtgaaggtgctttatttggtgctgtgcaatcaccaacgactaaggttgaaggttactcttctccaatcgttgccctaagaaagaatttgggacttttcgctaacgttcgtcctgttaaatctgttgatggtactaaggacagaaaagttgacctagtcatcgttagagaaaacactgaagatttatacattaaattggaaaagtcatacatcgatgaagccaccggaaccagagttgcagatgctaccaagagaattaccgaaatagcaaccaaaaacattgctactatcgctctacaaatcgctcaacagagattggaacagaacggtcatgccactttaacagttactcacaaatccaatgttctttcacaatctgatggtcttttcagagaggtatgcagagaaacttatgaagctaacaaggacaagtacggaggtgtccaatataatgaacaaatcgtcgattccatggtttacagaatgttcagagaaccagaatgtttcgacgttgttgttgcaccaaacttgtacggtgacattctttctgatggtgctgctgccctagttggctccttgggtgttgttccatctgccaatgttggtccaaacatcgttattggtgaaccatgtcatggctctgcccctgatatcgctggtaaaggtatttctaatccaattgccaccatcagatccactgcattgatgttggaatttttgggttacccagaaccggcaaaggatatccacaaagctgttgatgccaacatcagagagggtaaatacttgacaccagatcttggtggtaactccaccacccaacaagtgttggaggatgttctatctaaattagattaattaattaatatataatgaatatatttctacgtttgttacgccaataactttgctatgattcgatatttattttatcatggacagtggatatagaactaatggacttttactaatctcgctcaaagcatacggcgaaaaagccaatgccaccatcttccttcggtaaagccctgatgcacccttctgccaactcttttgcttcctctttcggaaacacctcttcaaattcactggtccatcctcttctaggccatgttggaattacaccggttctctttcttactttccaaccccattccttgacctttgagtctaagagcaaatcaatgacaactctttcgttttcttcagcatgaatagaacaagtactatagcatattttcttagcagatgggaaagacatggcgtgtttcacaatttggtattggaaagatgataatttggctaatctattcttcaaatcttgttccttttcaaacaattctttttcttgctccacaggttcaaccgaggtctgatcttcatcggtgtttgatgacccagtcttgctcaagtttactttatcaattgccttacggccaaatataccagagccagaacaacttggatcaacgatgaatccagttacattctggaaaagttctggtttaccaagttttgtgaaatcaccaacatgtatcttgacccccttagcacaacccgcggtggcaaccatcatctgtaaagtttttgcacgctcaggatccttctcaaaagcatgtatcttgactgaatcgaccttggtgtcaacgtctccaaagatatgtgccgcaacgtgtgtggttttattgccgggagccgcacatgcatcgataacaacgtcagtactgtttggattgaggatgtgggcggggaaacaggatgccctgtcttgaatgataattttccccctcttatattgctcatgcgaagtgatcttatcacctggatgaatgccaaacaagtttggaatatactcatcgtaatatatgctcccaggaacgatttgtttccaagagttcactctttgtgggaatttcttgtttaattcagcaagaacatcgtcatatctttccttgacaaggatagggttaattctgatccaacgaaccggtgtaacatcttctccatcatcggttttgattaactgcgacagactggtgactttaagtttaactttgagctttgtcaactcagcctttaacctagtctgatgcttcaaaatgaaagttttgataggatgcttacccatctgaatccgcttcgattttgaaagtaaaaggtcgtgtactaggagccttatggtatccttattgaacagcggtttccctttctttttcggtacgtcctccaagatcccgctcttcttaatgattttatctagatattccctatactgccatgtactactaacaatggcataaatgtgacgaggatttgtcttcagcttatatcttttacaactagtaagtaccaaggtctgtaacgaacctgcaactctcttgtctttagagagctcctgttccacgaattccaatacccaggttgcatcacggtagaattccatctcgaatcacaatgaagttaaaatgaaaatccaatgaaatagcgctgtatagcttgtaccacagatccagcaaaatcagttctaacacgtaactatattacgtctattctatacctcatcgcgatgagctcttgttacatgtttcttcatacgtattatacattttcaattttcagtacttgaagagtccgatgttgaaaaataatttcttttctattgtcacctcagtttggttttctgtaaatattggaactttaaaacatcaacaatttcctgcgctcatggaaccatatgtgaaacagctgatcttcatacggatcttctgagtaccagatcctgtgcaagacagctacgtccatataaccaaggtcaatcaaacgattctgacggtatctgaacacaaaacaacttttttggccagtaaaatttcgagagataatccgaacgaagagagttctctcacagcttttccgccattttcagtggacttttagcctttcctcacgattagaaggtaaaaaggcgctctagggaattaagcgtgcattggagttacgtaatttgtggttgtatcattcatttctagtagaccgtttcccattgaaagctagttacggtatcccttttgccattgcctgtcattcaacattatcgtggttacctttccataatatattcggaacatggaaagtaaaaaaccggctgaagagccgctggaaaggcccagcatcaaggaaattaaaaatgagggtactgcatatactctgcccagtaaagatgaatctcaacggcctgtcattgttccaccaacgaagccaaagattagatatagtcttttgaaaaccgggatctgttatgatgtgaggatgcgttatcatgctaagatcttcacgtcttacttcgaatacatcgatccacatccagaggacccccgccgtatctaccgtgtttacaagatcctagcggagaatggattgattcaggacccaactttgagtggtgcagattcgatcggagatctaatggtgaaggttcccgtacgtgaagctgaagaggaagaaattttgcaagtccattcaagacagcatttggatttcatatcacagacagaacagctcgaacgtgaaagtttactcaaggagactgagggtggagattccgtgtatttcaataatgactcgtatcttagtgccaaactttcatgcggtggtgctatcgaagcatgtaaggctgtcgtcgagggaagagtgaaaaactcaatagctgtagtaaggccacctggtcatcacgctgaacctgaaattgctggtggtttttgtttgttcagtaacgtagccgtcgctgctgcaaatatgctcaaatcgtatcctgaaagtgttcgtaaaatcatgatcgttgattgggatatccatcatggtaacggaactcaaaaggccttctatgacgatgatagagttttatatgtatctcttcacaggtatcaattaggcaagtattacccaggtactatccatggaaactatgaccaaaccggcgaagggaaaggtgaaggtttcaattgtaatataacgtggccaacaggcggtgttggtgatgctgaatacatgtgggcttttgaacaagttatcatgccaatgggtcgcgagtttgaaccggatttggtccttatttcatctggttttgatgcagccgatggtgacactatcggccaatgccatgttactcctgcttgttacggtcacatgacccatatgctactttcgttggctaaaggaaacttgtgtgttgtcttagaaggtgggtacaatttggattctatagctaagtcggcgcttggtgtttgtaaggtgttggtcggagaaccaccagatgaattgcctgctcctaaaaagcaaccaactccagaggcaaaaaaaatgatcgaaacagtcatcagaacgcagtcaaagtattggtcttgctttaagaacagacatggaaatgacgggatcaatttcaaggatgctataacttcaacattggacacaaggaatttccctttacaaaatgctattagagaataccaagtttcacagctctcatcacaattcaactttgttcaacttccaattcttgatttgaatttaccagcaaatactatgctatgcacctcaggtatccaagactctgaaacacttgtggtgatcgtgcatgacacaccagagatttggtctgaacgtgacacacagacaggaattattgatccttctagttcaattatcgtcgacaatgctttgaagatgatcaattgggcaatggatagaagatatggaataattgacataaatatacctcaaacactctttgaacatgccaactacccaggtgttgcgtcatcacaagagattctgatatatttatgggataactacttgaaattcttccaaaatctacaaaaggtggcatttatcggcattggagatgcctacggaggcattgtccatttattaggccatagggataccaggtcagtggtaaaatgtgcaatatcatttttagacaaaaaacctcttaaagtaatggtgccattaattgacgaaacgttaggagattggtatttcaagaattccttggtattcacaagtagcacacattcttgttggggtagtacggccaacgaaaataagaagttaagaaagaagtatggtagagttttgaaggcagattgtgacggaatgacaaacatattcgatgaacgttttgaagaagcaactgatttcatattggattctttcgaagaatggagtgaatcggaataattagaatatcattataaagatatatgtaattttaaaagtattctataatgcacttggaaatcttctttcaaactctttcatttcttttcgagattggaaagggctacccacagaatcttgatcggaatcctgctctttaacttcggattttgctgggcttgttctgaaagattttgcctttaggtgtttaggcttaggtggaagatttggcttcaaatgagctggtttgggtggcggtgctggtttggatttaggagcctcatgcacaggagtgatcactgtacttgatttacgatttgcattggatttatggtggtcagatatatcggttttcctcccaatatcagtatatttcccgtatccagtggcagaagagcgattgggtatatcatctgcattgattagatctttaacgcgcttctggatcgaagatgaagttttcaaggaagaggatcttctcagtgatgattttggtttctccttttgtatatcttcgatcaattcatagtcattattttccggaacgaaggaaaacgagctggtggaccgcctatgggatttggtgttagaagaagtattttcaggaatggatttgcctgaagtacttctatactttcttgcttctaaagatgattttctggaactgctatcaccagtgaactgcattgaggaaattccctttcttaatgcgttaaatgcggattttacgctttcaccggtattttgtgcacttctaatggttgaaaagcccctcttctctccggtgataacttttttcatcttagaacctattttacgagtcaagctaccgccagttgaggtagcttccaaggattccgcagaagacagagatgatgcgactgattttctagacagagatcgtgaaagacccagttctgatggatgatcgctggtttgagtttcagagtccacatactttggtctatctaaggatgttctgtttgatgccaagatacttgaaatggcacctctaccatttcttactggactcacagaggctctaggcactactgattgcgatcttgtcagaagatgaggctgttgatattctagttgtggtattctcattgccctcggtagtgattccattgtagcagaagtagacaaaagagcagatctatcaattttggagaatggatctgaacttgtgtagtttgaaaccgtctgaggaactgtttttcctgcaggttgcttttgtgagagtaaatcctgctgtgtgaccataggttgactcttagacacatgcaaataaggcaagtgctgaatagatgcagttttcgatggagtctgtacgtttgatacaacttgggggggcagatgctgagttgaaacagaagttggcacagttgccggcacagtcatctgtggcacatgaggaggtggcgacacccttggttgttcctgtttatccatcattcttaacagataaaagtttttgattggacatggaatgccttgaatacgtgaaacctcttctaccacttgacaaatattcggacgtttcagaggatctacacgtaacatgacacttatcaaatttttcactctatcagaataacgtggataggctgggaactcgaatttagatgctaagatggcagattccccatttttctcgaacggcgtagtataatagcatgttttgtacaggaagacacccaatgcccaaatatcagacttctcgtctatcggtaaaccacggtataagtcgatcatttctggacatctgtactgcgccgttgtatttttcattatatcgtactggacatagttaaactcctctgtatttcttggcgctcgaatgacaccagacactgatccgaaatcacaaagcttaaattcatgatttttcgagagcaagacattctcaatcttaatatctctatggatcaatggtggttgcagagcatgcatagcagcaacaccttgactcacttgactcatgatattgagaatctcaaactcttgaagtctattctgcaatctggtattcatgaaatcgataagcccaccgccagaacagtattccataagcaagtacacttcatacattcctacgttaaccggagacttagtggcatgtgaatcgatatacgaaacaatgaatttgttgcctctaagagccttcattgaatccacttccgccctcaatgtgttaagacttgctttgtcaggaacaacaactctctttaaacatgctacattatctgggcataccggatctggcgggctaatttcaacggaatatacatgcgcgaacccaccgctcgcgagatatttcaaaaccttcacctgatgcgatccaacaggcaatatggtacccgatgcgtatttctcaatttgcggctgattcattttaaagatccatatagatgtgaattcagaatgcaaagaaaaagagaaaagccagcagttaaaatacagtaagcgtataacgccaacacaaatgggttaaccttcgagaaaacttttgcaaatgccgtctttcctacgtgctctcttgtactgtgacctatagcacaaaagtatataagcaaattgatggaaatttgtccaggcagaatgaagtaaaaaaaaataatgcaaaactcacaattgataaaagtgcaccacttggatgaactatgaaatgcaaaaaaaataaatgtaaggataaaaccccgtagcttggtggaactactatgcttcttgttgccctgctcaacgctgtaaacctcattgaatagcacttaatttaccaaatctataattttttatatgaaaaaaaaactgacttccattttcaatgttcaagcctgatttttttgtcaacattggaaaatgttaataggggcgggtccctaaaaagagtgataacaactgcaaggaaaaaggaacaataggtgaaggcaagtcttggaccctggtgcttacttgtgcccttattttttgtggagaaaagtttctcagcagggaatagttacagcggtggccttgtggttttgctaaggcctcctatgctaataaacattaatttggaataatgtggcttaaaaaaaagtgatggaatatatggttctcttcagcctgtgagatgtcaagatgttgatgttttttatctaaccatttcagtcacgtgccaccagatctggatcttcagaatcagatgaatcgatatttgttattagctgcatgtctatgtaacatattgctacttatccgtcaattagattggtagctactcgattattgttcctgagcggtctcgccaccatgcgccatgagtttggaaaaatatacgaaaaaccataagatctggttccttggcccagttggttaaggcaccgtgctaataacgcggggatcagcggttcgatcccgctaggaaccattctttttaccatttccttccaccttcgaacatgaatctttctttttcagtagttaaagctattatttttgattagaggtagaaaagattcatctcatcccatcgagtaaactagtttgttaaagtctactgcactataaccagtcacggtgcgaagtcccacaatgtccttcaacaaatacaaatgtcgctactttgaagaaaacaactggtgcttgaaattgcaacctctatatcaacatggattgatgacatcgataagtgacggctcagtgcatttattggattggggcaacttgaaaaccatatccagtattcaatgccatacaacctccatcaacgatatgaaagttataaactccgattttgatactggtgctgtgttcgctactgcagcagaggacggtgttaaagtttgggatattagagcccgaaacaatgttgcgtctcttcaaaacgataaagcatctcccttcttctcattagattcaaggcacaatatgttagcatgtggcacagaactaaaggattacgatgctgaattgcatatttatgatataagaaactggactaaacctgtgcggtcatttgtggactcgcatcatgatgacattacagatataaaattccatccatgcgactcaaacttgctgatgagtgggtctactgatggttacgtcaacatctatgatttgactcaagacgatgaggaggatgcactacatcaagttatcaactttgcttccatccattcttgtggatggcttggcccgaaaaggatttggagtttgtcgcatatggaaacttttggtattcacgaattgaacgataaatcagatgaaatgatagagcctaaaccactagaatttggagacgtaagagataagtggggttgtgactatgttattgatatatacccatctttcattgcaactggaaaaactcatgaaagtcaaggtgaactcaagataataccattccaaaatgaacaagttgatgtttctagtgccctggtaatacctgatgcacacggaaatgaagtgataagagatgtgcttattccaaaaaatcaaacttccctcctatactcttgtggtgaagatggttacgttaatgtatggaaggacactacgaactctttaaacgttccacacaacttttgggattatacactaccattcacagcatttgaaaactctgtcagagaaattgaaatggatatgggacaagaaacaatgcagcacgaatcatcctcaacatctgaacaggattctacttctactggtagtgatgatgaacataaagaaaagaaagataagaaggagaagaagcacagcaagaagaataaacatgggaaaaaagataggaagagtgataaaaaatccaagtctaaatccaagaaggagaaagaacaccgttataaaccttattaatattgtgtatgctattatcttcttttacatgaacagtctatttaatgccttcgcatatttaaaatatacacttattacccggatatatgtcactgtgccttgtttgattgacgaaaatatggaattttgtaataaatatgatagtaaacattaatatggcgacagtgctatatattttgatgaatgcactattcattaggtagtagctaacatacaacaaagaatctttgaagctacactacccagctgacaaccatgagtagtgttgtgaataaaagcgccaagcgctttgttcctaaattaagagaaagacggatactgaactccacaccggctccaactgtggtaccaccagtgtccgatgacataaccaagtctactgctgaagattcccatgaaaatgaagccgataacgaggacggactgaatgagtctagtacagataatacggagccaaaaagaagtgatgaagaatccaaaattaacgaaactgttgacgaggacgatccactaagtcaaacaactttagtcaagaatttgaacccatcaagaaccagcactcagataccggttgtcacagtatcaagtgctaccaaccgccgtaggtctagtagactagactcgctctctggaactaaacctactttcaagtctggtttcatggggcctggttccttgaatacgggaaatgtaccagaaagaagcagaaggctctccagtatatccacagggtcactgagaaagaagagtttaacagttaattcggagaatgattcttcactgcaagcaattaagcggagacgaatgtcatcaagatcctcaaccggaaaaggaccgggtaaagttcaaaggattagtatagtatcacggatgagtagtccagacgacgattcattaactgcaaaaccagctggtgactctgaaaactgcgacgatatcttccaaagaactgatgatctttatcagaaatacaccattaccaatttgaagatgattccaaagaaaatagcggacaaagattcatccaaatacttgatagacgaagaaaactttactatggcggacctatgtaaaccaacgcttcccataggtgaaatatctgagaattttagcagggctaaggaagctgccaagctaaagattgaaaggagaagaaaacgcagggaactacgagaaatggctagaaaagagttcaagtccttgaatgaactagtaacggaagaagaaaaacaattgaaagaggaaagaaagaaagccgcccaggatctttttgatacggaagtgccagatgagaaaccccatcaaggtattcaattgaagatggccgcagatggatctatggttgttgatgaggaatctatggttgtcgacagacataagaacgcgtctcttgaaaattcatctaaagaaaaaattcagaacaatccattcgaaaatttatacaattctgctacgtacggtcgtcagcagtttacagatccatggactattgaagaaatgatcaagttttatcaggcgttatcaatgtgggggacagatttcaatctaatatctcaactgtttccttataggtcaaggcggcaaatcaaatcaaaatttgtgaacgaagaaaaaaagcatcctgtcatgatagaacttgcattgagatctaagcttccgccaaactttgaacagtattgcaaagaaacaagaaaaaatatcggcacggttactgagttcaacaagcgcttagatcaactacaagtggaacatgaagagcatctaaagcaaattgaagtagaacgtcaaaatgctagagagcaagacatcaagcaacaaactgttaaagagcatgaaagatcacaaaaaggtaaacatggaggtaggtacgatcaactcaaaggatacagaaaatcggaaatcgttcttggatctatcgatgacctcaaaaagaagagagctgaggaagcagctattgaagctcaaacttagtataatattaagtatgtatctctaaaatatttgatctgtcttaagaaaggactctttcaacctgaattcatattcatggagttgtgcagactctaacatgttgtcattttcttaaaattcaagacgaaaaacacgaaagtttattcaaaaaaccctttgcatgattaaaggtagtgattaattaagagaagtaacctctgactggcttttacttggtacgacaagtatgactgtcaccacaatagagcataataataatgttgctattaaatttgtctcgacaaacagatcagttagccgtatcatctcaagacaacaatctattatctttctctatgttatattatcaattatcagactatcatacgcagatacatggccggctctaaaatatgtgaatccaatttgtctcctccttttcattagagtaccaattatagattcagtacagtctattgccaaccagggcattcaaatatcatgttcgggagggcttttgttgttccccagggattggaattatgcattattcacaagtatcaaattcatccctcaggatgagatagaagacattttcatcaacgaagccttcagaggattacaagtcatatactatcttgcagtgttggtcaagaaccagaagaagctacaggtactatttgaggtatgtcacgtgatttaataataaccatcatttatagtagtaattcatctgtgagatgcaactatcaactagtggcaacattccgactttttgctggaaaataccatactaaccaattacattgactgttaaaatcagagaaccttacctagactgcaagatttagtgccagtttacagtaaaatccatgcaaacctttttgtagatagtgatttcaaaagaaaacatcaacataataattccataaacagattttcgaagagatgaggtgaatgaagtctctaagtatacaaggcagacaggtggaaatagtctctgtcaacagtttcactaagttctctatcaactaactttatcaaattttttgctggcaaactaaaatggcacggaaattgaaggggaagatatcatccaaaggacttaaaggtgctttgttaaatcatcaagctagagaagaaagggccaaaaagattcagcaacgagagaaacatgtggcagctaagggtaagccgactaaacaacctttaagacaaaaggaacaacaacaagtgagagggtcaggatttttaccattttcttcagattcaactctgttcttggttggtgagggtgatttttcattcgcgaagagcattattgaacagcaatacattcaaccagaaaatcttattataaccagttttgacagtggaatcaaagagttaaagctaaagtatccacatagcttcgaagaaaactacaatttccttaaagagaatgaagtcgtcatgctgttcgggatcgatgcaacaaacttaaaaaaatctttgaagatcacgaaaaagactccatggcagaaagtagtggggaattcatggactacaaagaaactggatttcatcttattcaattttccacatacaggtcgtggaataaaagatcaaggcagaaatattcacgaacatcaacaattggtgtacaaatactttgatagttgtaagcagctgttcagactcgtaaacagtagccagattatgttaaactcaagcatttctatgggtggatactcactaaataatgaaactcgagttgatgatgaaggttatggaaaagtggttctttctctatttagtggcgaaccatacgattcatggcaaataaaaatactagcgaaagataacggttggaaagtggatagatcagggaaattcgactggtccaagtttccagggtatcatcacaagcgtaccaatagtgaaatggatactaccaaaccagctgaggaaagagatgccagaatgtacgttttcgaaatgttcaataaacgtaaacattccaaaaaacctttgaaagacgacagcgatgatgaataagaaaatacatattctctattatatctaagtaggatacattttgataaagtctgttgtagcatatattgatttatcaatagggtccatcacttggttttctttaagtttagtgtaccccattttgtttagttttcgagataatgatattagcttttcagagtcgtaaatattgccatttggcaacattactggattttcaaataaactcgattggatatgatgggcaaatggtaagttttcagatagagggaatatgtcatgattgcatacgggacaatctgtattgacaacgttagatttaatgtattcatttacttccggattttcatgagggattagttgcgcggaaatggtgtgaccacaatcctttgtttttaacgaagagattcctaaggatatatatattaatagtggatcgtggtaagatattttgtagagtgagtaaaattcatgtaggaacattttattcaaactttcccatctctcgtggtccaataatggaccatatcgacataattcagcattgtgaacaacgttactagaagaaattgatgacaacggatgtggtcgatacatttgttttctaaaataggcatgaaacaacttttgttcgtttgttacttcgtcgtcacgaccattgttgaggcagcttttgaagaaagcaagaatacccgctgccagttttagttctttgggatatatatttgcgaaatgggcaaggtgtgtttggaagcacctgattgctgctttataatcggaacatcgtactaattcaatgtactcctgcaataacgcttggaactgtaaatgcgaacctttttctgtcaagtgcgcagagttattttcaatccactctaatagaggacgaaggtttttattttctataagttccatagatatctgattagcttctatgagaacttcgtaatcaatcaaatcctctaatcccctagtctttataaactctatgccagagtttgatgcaatcttgtttttatgatctatagaattcgaaccatgccttaccaaataatcggcaattaacaaatccgtgtatgacctgtaccattttagaagcttgtcagtgttagaatcatatttgaatctttcaaactgcttgaagtattctactctcttctcaatcctttctaaaattgttaactcattatcatgtagttgcgatagtctcttctgcaaaatgttcactgtgttgattatatcattcaatttttctattgattgctcatccttatttggatcttcaagtaaagtgttcaaagtagcgaattgtccctgtagctctactgaatagcttgtatataggttgttgaatttatcccagtttcgctttaacaattcggaaggaatgttaaactgctgctggtttaattttaggtgaaaatcgacattaggttcgtttaacgaagtcataatgacatctaaaggctttttggtagatttaccgtcaccagtattacactgattgatccagtttgtcagttatttggttcatccctaaagattaaggtatattgtgaaaacccctttcaattttcttatgcaatttgatgcagaaatacaaagatatagttaccatgaatgaaatacatcaaccggtacgctggaaaaaaaaaattgctaaagtcgagttgatgcagtaccaactggagggtaggaatatcaggcgaaacattacagacgtttgtttatacactgttagtgaaaagataaataccaatggctaagtgttgcgcctaaagtttaagacccagaaagcatcaaacagacgaggacagaatatattacattttaataattttatttagaaagctccttgctcataatctagccaagaaagaatgattggaaccattgaatgatttaactgcgagatgctgaactggtcatacaaaaagtgtgatatacacacaacttaccataataataagaccgtaccagactaatgccagacttccatatctgtgagctttatcccatcctccgattctctcaccgttcatcaaagattcagtaccaattaacttccacccaaataatcctggcaacgtgaatgaaatggctgtagaaccagttgcaccaacaagtgcaagaactaaagcgaatgactcaacgtttagcgctagaacgtatagtacagcaagtaagaagaaagtgacagtcaaaaatctggaatcagggaatgggactgcttcagtgcgttcatcaacctgatcatcattatcatcgtcggttgccctcggtagtgattggtacgtgtggacaaatgaagtgtcatgggaggagcctagctcttgttcgaggtattctctatcagtatcatcctcaatttccagggtaataggccctatcgtttcatctatttcagactttgttccatagttcaattgtaaccaatggaccatattgttcgccgatatacggcaaggatggaacaacaagggaaatgacaaaacaaccatcaggccaagattgaacctagcaaatctgacagagagcttatcagcatcatagtttagtatgacatttcccagagtttcttttccgaaagtcaaatatccgaacagccccaagattatgaaacaggcggatgatactacgatggaattgtttatgatctttttgatatttgtcattgaattttccttcaattcatttattatcgaaaatagattcattgaaccagtaaatgcaaatacaataatactaaatgtcgtcaagactccagatctatccgatatagagaaccaatcaactttgggttttgggtaatttccgaaggaatagcttccaataatcaataaaccaatgtaacccaatgccaacagaccaataacactagtatatttcaagctatcaaaatgtcttaataaagataacggaacgataatgattgctgacaacaatatccagtttgtcctcgtgccgccaaataacgctgggaataagtcaccaattaagatcaaataagaaagagcaaccccaaaacattgtatgaacatagcaaaatcaaacagcaaagacagattaggatatgtaatagaacataaagtgaaaaaagaagagtgacgtggatttaacaatgtctttgagcattttgctaggataaataagccgtaccctgatgtgaatgcagccatcagtatcaaactaacagcaaaaaaaaccccatcacaacggaaagcatatggaatagctaataggcctgcgccgacaatagtctttataaggtttatagtagatgatgcaacagttccagttgctgacatagctcttttaaggtatatcaacaactacttattatttttgtattcaaagtgtgagagaacaaaacctaaattatgatatgatagttctcaccagtctagaagaaacccgaacagcagttacaggtttgaagtgactgtgaatcaactctgtaagcaaatgaatttatcaatcacaggctccagctttactcctttcaaatttctggatgtcccaaattacctttacatatcacccagtgacttggaatttattatttgaatttcagttcctttttcatgttccaaaatgctgaaaagtaagacaattcgaggaacaagaatatcaagattgtacaaaggaaccacatgctttgagctttatctgcataaaaaaagccagcagcaggtctgactacggaccttaaaacttctgaattcgcaaaattgatcaatttactgttccaaattacgaacctggggtttgacgtgcgagaagaactgtatatttatggttatatccgtcgtactgtgaacaagaaatctctcgaagcacaaatgagtaatgaaaacgggaggccgaaggcccacagattgagaaaacacggaggggatgagacagatgcggaccttgattctgaattggagatgatggataaactcaatatggcgtccagactagccgagaacaatttagccaagcttttagataacgataaagacttattaaaccgagtagaagagataaaagcgcaattccaagacagggccaaaacacctttcagcgctgaagaagatgttgatgatatatatgatgcagatgagcatggggcacggagccggcaaatcatgtctgcgcgttccgggacagggaacaaggaagtaataccgccagagaattttagtcatgtctgtggagaaatatatcgatcgagtttccccagaccagaaaacttcgaattcttaagggacagactaaagttgaagagcatattggtgcttattccagaggagtatcctgccgaaaatatgaaatttatggaagagactggtataaaattgtttcaagttggaatgagtggtaacaaagagccatttgtaaatattccaagtgatttattgacaaaggctctcgaagtagttttaaacccagaaaatcacccaattctaatacactgcaacagagggaaacatagaactggttgtttagtcggatgtattagaaagttacagaattggtcattgaccatgatctttgacgaataccgtagattcgcctttccgaaagtacgagctttggatcaacaatttatagagttgtacgatgatactgggatcataaagctggccacggaaaacaactggctatctgttgaatggtgaattgaatctcctcattgctggacctttttttttttttttttgaacagtgggtgaatcaattgagtcttcatatctaaaagaccaaaattccttattaacaactagaattgatgtcaacattctagtgtgtgaatattatgttccgagtttactatgtagtatcatataactaaaaaatcctcattcttaaaaaaaaaagcgtcatggtgcgctttttgatatgtctgattccgtctattggaatcccgatgcaacaaacctttctaccatacaatgcagcgctactggcagaaacggtcgtcaacagcaaaggccaaaccttaccataacgcaatgccttaacagatccacggccaccaactaacaagtataaagagttccatgcagccaagaaaccagttcctgattctaagtccccatcgtaaatcataaatccaccgatggcattagctaaaccaaacattaaggaaagcgtctttgtaggtccaaagtatctaggtctagtgaaagctgaaaacatcgattgtttctgagccataacggacactggtgtttgagtggccggagacactactggagtagttatcaacatggcaccattaagccatgctaaatagggtgtttgagaccattggtatatatcgctcagttcagtgccagacattagtagatattcgttcgttggtttcggtcaggactatagtatctatgaccctgaaattaccaagtaaatgtgaaagctatagattccacaagtactagaatagagttatctttatatgctatatctgctatatatccttgtatttttttttttatcgtaattgcattaaagttaagtagaggtctttaatttcatacagacttaaatttcgaagttccacaacaatagcaaacttcgcacaactcaagagtttctctgcagagagagaaaagtaaaggattgaaatgaaaacccttctactactgccgcagctaatgcaatttctaagaataacgctcgtttgaatctttttatttcatatatttgatctgtttaatgttacatggttagccgtgaaaagcctggataaagactaagtatacaatactctctaaataataaaaaaagtgaaacctggtagcggaagaagaggagaggataatgataaaattatgatctttcacctctcaatcttctagccaacttgatgtccttcttttgaatagtgactctcttagcatgaatagcagccaagttagtgtcttcgaacaaagagaccaagtaggcttcgacggattcctgcaaagcaccgatagcagaagattggaatctcaagtcagtcttgaaatcttgagcaatttctctgaccaatctttggaatggcaactttctgatcaaaagttcagtagatttttggaatcttctaatttctctcaaggcaacggtacctggcttatatctgtgaggcttcttgacaccaccagttgatggtgcggactttctggcagccttggaggctaattgctttcttggtgctttaccaccagtggactttcttgctgtttgcttggttctggccattgtgtttggtttgtgttggttatgagtacaacaactgtaatatgaaacaatataatgaataagataatttactacaaagatagcactctgtatataggatttatttttaacaaacttcataaatcagagaactaacacagaggaaaaaacaactctttatataagaaatatgaaatacagcaacagtatgataaggcaagaattaacaactgcatccagttggcccaaaaccccacgataacagttgtaacccgccaaaaaaaaaagaaaaaaatagtatgagagatatagtcattctcaccgtttctcaacggagcacaaaacgtttacaaatcaggaggtgaaatgacttgaatcagaccggtacagcaatttcgtcatatgctgcgaaattatcagaatggctatagtctgtctttttctccgtttacgattacttcactgcatagaaattcagtaggcgaccacagcgaagctgtggtcacagtttcagtccaaatttcccttaccacgaacttttggcttagtgggttagaatcacggtaacacagacacaacaaccttaacgttcgtgcctctgtccgtgtgctaaaaagcttacataggatctgcataaagaaccataatgggaaattttcactcaatcgtcgtgctgaaagctgcgcccgaacgtaacagcacggcatacgcgaaaaggaaattttggttttcgtttttcattttttttgttcgctgttggcaatgtgcataacgtgcccgcgacaccatactgaaatgtaggtggtattggctcgggaaacggtgcgaaatttacggtcgacactttgcgattccagtgcggtcatgccagcacctactctcccagaaacacctccctatcggatcttttttttttttgctaacttttctttactgatttctctcctgcctgtctccaagcacaatgttatgccgtcatctatttaatatataaaggatacacttctactatattaattctcatcctcttgtgggttattttcttgaactgttttctgtatgtttccttatttcttattcccttgttgttatttatttcttgtctgttcatatattcattataggaatcgtcaaacaaacatatatacaacaatcaaacaatgtccggtagaggtaaaggtggtaaaggtctaggtaaaggtggtgccaagcgtcacagaaagattcttagagataacattcaaggtatcactaagccagctatcagaagattagcaagaagaggtggtgttaagcgtatctccggtttaatctacgaagaagtccgtaacgttttaaagactttcttggaatctgtcatcagagatgctgtcacttacactgaacacgccaagagaaagactgtcacttctttggatgtcgtctacgccttgaagagacaaggtagaaccttgtatggtttcggtggttaatcaacttaaagggaaaaacggaatattgtggctatcgtgtatattcattcggtcacgtgcattcgatatcttctctttttaagtctgttttctttcatcaaaaaaataaaagctgttccgctctcacagtgacacaatttttctgagcatggaatgaatcttccatccgatgatcagttcgaacaggggttcacttatgtatactctttttattaatgcgttcttgatatgacagggactgttaatcagaaacatcttcctgtttttacctaaagtatctaacgcgtgtgtgtattattactaaataaatataatttcttattgaaatataaattcgaatcaattggtatttttcaaaagtttatggaactgcaaatgtaggatgcagctcaattttaatgcatatgctcttctggtacctttaatagatattaacgtatatatctattaattattattcttcgcaaaatgtcttttgtagtcattagcgagtgctacttttaattctgctgcattaaacggtagtagggattcttctcgcgatggagaatcgctcactaggtcgaaccattgcatgaggcattggtgcgatgtatcctccacatctataatatcggggcattggcatctgcatccacttcctgtatcccaaccatcgtctattttgccagtcttgaaatattgtaacgctttctcttttacactcatcctagatgactctctttcgaatatttctgtgtattttgacgattccacatatggtaattgctttccctctttgttgttggggcagtgtacgattgtagtatgttgatatccgatatctctgaaataatggatgtcttctgcattcaatgttaaggccaaacctaacgaatgcacaggcgcatccccccatctttcttgccagaatccaccccacgactcaaggtattcgaaatacttgttgtatacttcattatcaaatacatcaactctagcaatttcgaaattggaccaaaaatgacataaattgtactcttcttggtcaaatttgtcttcaacgacaggaactttcctcctgaccctatgagcaatttcttgtattagctcgtcatctatgactttttctcttgcccaattcttcttcaaatagtcaatcagaaattcgtgggtcatttcttcgttcaattcttctagttcattgacaaaggaatttaaataatcatctccgagtaaaacgtttctattcttaataaaggctttccacagtgatccgagtttgatatcgttttgcttgatgaaacttctggttgctctaaataagttcggcacagtccaatatatttctttgataaaaattgtgaaaccgtatttctttcctgccttcttcatttcaaagaatggatcataagttagatcacagaagaattccacatctggttcaatacgccagtaccactcgtattgcctaactgcagggtgtttatagaagagtccggaataaaatctgcacatcttatggtatgaaaccatattcccatacataattccacgatcaccctgggattcaacgtaatgctgaaatagtggagtgttctccttagggaaattccatgaggactcatctacaagggcaaacgttatgttggcagttgttaatgatcggactctttcttgaaattcatcagtgaatggttcgttgttcataaaaacgtacggatattggaaccattgattgaatcttctttccacagatctcatagtgtgaattaccccatccagctcctcgtttcttgttaacatcacaaatgtggcattctgtcgttcatattttttgtgatttagatattctgcagtatccacacacccttcaaagaagggatgttccttcttagaggcgcgatccgctgaggagtagactacagcatcttcccatattgcagcttcttccgttcgcacaatatggtgtacaccaacacaaattagaagtgcaattgttatcactatcagtagctttctggttctattcctcatgagataagatggaaactatcagtaatcatgcaaaaaaaagtggaaaagatgaatgtgtacgtcccaatagttgaagatgaaagaatgaggttttatactaatattcttggtactttaatcgactgttgagtttatgtttataaatggatcgcgtattgcgcataaatcatcgtcaatagataactgaaatatcaaaattcagattctgttcacttttttgtgcatacattaaaaaatacgcagtattataaagtagtagtattacacatgagatacactaaaaatacaaggtataagactgacaataacggatagtatttgggacctaagcagtttgggaaatattggatgacagaaaaaaaaaactggtaacattttagtttcttcacttgtaccccagaccagatttacaagataaatccaactattgatattcatttgaatggggctggtacttggcccgttagctttcttatcaaagatatatcatcagtaacctcatccggagttaaagattgaagaataggagcgctttttgtcgaaagtctttggtgacctcgacccatcttcttttccttttccttttcctttccgaacaataaagcctgtaattctgatgaatcgctcagatattgcatcgactctgcatcgctattagtattgcttgatttcccgcttccgtttgcaggtgtaatgtttgcaggagtttgagctctattctgattagtagcagcacgcctacgcaatgacctcctatcggtagtattaccagtctcattgccactttctgtttggctgacatcgttcggtgacgaatcccaagccgaaaaattggctgaattttgagttgagcttctagtctgcttctggaatttccctcgagaataatccatcgaataagactgtgtgtttgctacatccagaagtagccgttcctcttgcaatttcttgatagttttctgtagggattcatacaacatctctttgcacaatttgatcatcctttcatgttcttgcttggctttttcaatatcttcttggaactctactttggacctgtaaatccggtactcttcgaaaagcctgagcctaactaattccaaatccctatcttcttcaagatccctcaatttcctcagaaattcagggttattcccctgatgcagcgtcgttaaatctgtctgtaacagagtcaacctatccctataatgcacatctttatcctttgcaaacgacgttcttatctttcccactttcccttcaaactgtaatcgcttcttatccttcctactcaaatcctgcccaacacctgcgggaatagcacccccattctgtttcgctccttgacctttcttcacaccgctgctcatcatagaatattgtacttcatccatgttcctcggggggagaagctgtatttactgcaaaagctgatataattgttaaagtgaaaccagaaaaactctccggtatcgtttcttaccaattatcctgtgaaattactaacacagaataaaaaattacaattgaaaacgttaacacaacgagttaatgtgctgctcgttacatgtatcgtgcaacgtatgagctgggtacaaattatgtacaaattatgtataaagtatgtacaaagtacaactgcttaagctgctctgatttaaaaaaaaaaaaaaaaaaataataataatcaaatgagacaaacaagaaaatgccatgcttctgccgttcgaacctcaatgctcccataacactgatttattcattgcaagtatcaccattttcttttttaaattttttatgttccgttttccatctcatttccccgcagaaaagtcgcagcttcagataagaaaagcttaaagctggccggtataagtgcaggctttaagtgtgttgaaagtttttaaaggctttgaacttttggcaattttggtaaagaaaagggaaaattcccaaaaaaaaaaaaagtaagttaagttataatataatgacgatgtgattttttttttgttaggtgaatagaagtgaaatagtgagactaattcagagataaaacagtggtacgcagcctgtgatacacatcagtgttgtgtgttattagtacagataaatcgctgaattttgcggtgctttgaactacccctaatattctaatactttaaatttcgacgttataagtgtgtcgattttataaagctcttcttttcagtctttccagttcataggaaagaaagaacagagaacagagttttcgaaaaacatattggtttcccctttggatataatattacctgactttgagacttgtattccgagttgtttttgttgtttttttttttgactgagagaacagtatggatattgacgattatttgaatgtcgatagtcccagtgacatcggtgcgaatgtactgttaaatccggaagattctgacaattctcgagggtcgaaggttgcgcctggtttcaatgcgatgaataatagtaggaaatgtggtgtcaagctgtctgacttcggtggtgatatactgtcaggttttaaggagtttgggttcagtgtcgcgaattccttttcgaaagaaactggtgataataacaaaaacgcaccttcaatccctagtcttagtataaatggtgtcctggctcacgatatgcttaatcgcagtgtgaaaagtaacgcccagcttcagcagccacctagcgtcaaccgtaacaacggtagaaatgctaataaatatgtgtcacatgaattgaatataccaaacacagatccatcttttttgttccctgccttgtccactaatgagactgacaatttggatactgtgtcgtcggcatctaactcaccatatatttacccatcagatgcaatctcaccaagtactgggtaccttgctctggatagcgatgtggatgagttgcttagcgttcattcagacttatccgatgtttccaaagagtaccagtacatttcaaatttatcggaattacaagaattgacaggcaacgttaatgatcctttgcctgattatgttgatagtcaattcagccagttgcaagaattgactaacctggcgggtcaatctaatcataatactcaggtggaagatttaccgatgccacggataagagtcgataataccaatgtgactccaccaagaatcaaaattgaacagtttgaaagcgcgtcgaactcttccagacctgtacccactgtaggtacagtgacaagtacttttgatactactcattcagagctgtcgactccttccactgcatcatttgggttcaataattctcatcagatgttcttagatgctacaaaaaacaatgatagccacaataataatgcacaggatactcagtctacgttagatatgtcagaacaagtatctctacagaatgcactgtcattgcaacatgatttactttcggttactacacttcaaggcagactcccgttagaaaatgacaatatttcagatacctttgataagatgcttgaaggacgaagaaatagaaatagatcgcattctaggtcacactctagatcacgttcgacatcgagaaagtctatttctacaaggtccttgtctccagatgaacgtgcccgttctcttagtagagatcgggaacatcttttgaaacttggaggcaaagttcctaatactgaggataaaccaaaagataatggcgagtcaactttgaacttgattgggactacaaagaaaaaacaagctcaaaaacatccggcagtttatgcatgtgatatctgcgataaaaaattcaccaggccttataatctcaagtcacatctacgatcacatacggacgagagaccttatgtgtgttccgtttgcggtaaagcatttgctagaatgcatgacaaaaatcgtcatgaggatcttcatacaggtaaaagaagatatgtctgtggaggtatattgaagaacggtaattcctggggctgtggtaagaagtttgccagaagtgatgccctaggtagacatttcaagacagaactgggtaaaaagtgtattttaccgttgtatgaagaagccgaattggaaaagaaggctaatgaagcttcacaaacagcagatgccggcggttcaggtaagagcagaactgatggaagcatatgacattccaatagtgtccgcttactctaataatacaaatgccattctttcgcttaaactgtgtcattaaatgtgcttttttgccactaattcgaatcttttcccaagttatacataggtactctcattagtgtctcctacttgttttctaatagcacaaattgcgcatatataatgcattgtaatatcttttgtaacattattatctactttttttgttttcatttacagaatatattatgagagagttcttaatgaaaaatgtaaactttacaccattgaacaaagcagatatatttgcagttgatactactgaaaaagaagaaccatccggtttgaccagttactctaatttgttagcaattgacctcaatggaaaacctaattcatgagccatcaggcttggaagacagggttcataatggcgataatgggaaggatttgatcaccgccgaagagcagttcttacaaaatcagcaggaaaattacttactagatctattccaaaagaataagcacacacctatccatgtgtcccaagttgttctcaatggggcagaacaagtccgagatgatgttatacagagttacctttctgagacaattaataaagcagatacttttgaacaattgtgcaagtattcggattggtttcattataaaatggtcggtaacggaatggtagaatcagtatcgcaaagtttggatagcaggggtagttatcctgttcagatatcacaaagggactatggaaacctaaattttccttcttctggaccagaaacattatcggtaattgacgtagttccaattatccaattacatccaataaaaagattcagtgcgaaaacaggaacaaacattggtaatggggaaggtgacggttatattcaattccagttaaggaatatgttcaatgctggtgaaaaactaacgtttgatgctaccaaaggtacaaagacacattcgtcttatttattgaattatttccagcctttacaatcaccatggtgggttagtgatacaactgtgttcaaaaacgcacgtcagttgggacattgtgaattatttctcagaggtattgctagtggtattaaaagtggatacttgcatgatggcgccgtaaaccatgaatggcgttgggaaagcttactcaggagctgtgacgtgagatccgattttgcatcgtcccatttactgttttctgcaggagatgacgttaagcattcggtagttcactcaataaccagagatacgagagataatatcattgctccaagcagtggccaaatgtggaagtttatcaacgaagtgagcttagggaaattttggaagacaaacttggagtacaatttcaccaagagctggttcaacaggaactttataaccatgagttccaccgtgaaagcaggatatatacacaattttcatgccaagacatatcccttgcacctcgctgataaattctataatggagggagtaacgatgttagaagtttccagttgatgggattggggccaaaggacatctatgattatgttggtggtgacacatctctatcatatggattaagcctgtttagtcgactaccctttaagaggttttatgattcaaatttcagactgcatttgttctttaatggtggaagactcataaaccgtaacaatgcaaatacaacagatacgctaatgcaaatgctttcacagcactcattgtcgactggttttggtttagtattcagacatccggttgcaaggttcgaacttaacttcacggtaccaattactgcacatacatccgacgctactagaaagggtttccagtatggtatcggaatctctttcctataactttaccgataattaatgatccataaatcatgaaatataaaattagttaaaaggaatacaggttacaatgtaaaccccatattaatgactacataacggtatggtaaaataatacgtaaaaatgagaacttttcattgtttcccagttttcctccatgcatcatgtctcttgacgatttcttgtacgatcagcttttcaatgtttttatgatcatcagtgattcttatccagtcaccatcgcggttttgttccgaaacgaaaaccacttctttgtttcttgtttgcaatagattacctatcactaactggtggttataacggtccaaagcctgatgagctttatgaattaaaaggttgttatccgtttctagtttaaaagagattatcattgcttgagtggcccaagattcaaccaatctccttaaaaatttgggcacaggatcaagatttactattaatttcccgccaactgttgtagagctttggtttccgtcattcagtgattggttagcttcttgcgattgaatcttgtgttgtggtaaccttgaatatggaacgaaaaagtccgacacggcagccgcaaggtagaacaaacatccgctgttattcatcaaagcggcaattgtcttcaaagaccacaagtactggttcaccgttgtaaacggcaacatcaacaacttcttttccttgtatatgaactggtcatagtcacgtttattttgaagtatcaagtccttatactttggtgaaatactcccatcctcatcaaaataatccaagaaacaagtttctgtattatgaatgaaaggcctgttgaatggagtcaaagaaaactccctatggaggaatatcacagagtacccattgaataagaactgctctgcactagatgcaccacgagttcctgccgaaaaattatcgatgaagcgaactgtattgttttctaagggaaccgtagtaccaccagacgtcaccagaacaattttctcgcgaccttgagacttctgatactctatgaactgtgtagcctccgttaacaaatcgtccatgtacacaggtctgggatttgttctgaaatagttgtcctcatcgctcagatgagcaattggcaaagcagtttcatcgacggtacggtcaatggcctttgaaacctctgtaatcgatgtatgaatccttcttccagtcattattctaacggctcaatgcatacacagtctcagtatatatcccagtatataaacactttttacttccatcaagtgttcattacttgtaacattcctatagtaatgtaagtgactaatatatgatcatttcagtttctccaaagttgacatgacatgagtaggtagctcaggattaaggttttccaacgtcctgatactagcaaattttcgacagtaaaatcaaattttcatttttctatgccgtaatggcttaccggtcaacaaaacgctatccactgttctggtggctccccaattcgaatctcgtcagtaccataccagttcacctccaaaagcattcaccaatttgcttttcttatcactatatacgaacccaatacatcgctctcttgtaaataacaagaaaaaagccaggaaaaaaaaaacaaaacgcatctttcaggtcgaacctacaccgcgttctgagtactgttagaaataaacgctctagaaatttttcctgcgttttcctgtcctgttttccattcgatttcacagaaactcacagtcgtgaaaatatgaaatgctggcgaaaacccagattttttcacagatttggaaattgatatttggaaggaaaaaagattcgaaggttttcatttcaattaacattttgagacacccattggtagaattcgtgtttatgatctcaatttgatataaaccctctgtgtactattacttggaaggcgatttcagagtcattaatagcttaagtttatacccgaggtgccagaaaggatagagttctattctacattgcaattgtaaccttttttattgttttattcttttaatctaagtgtgttaaagaagagatctacattcactcactcacgtataccagtttattcactcgaggaagatattgatttatatcagaatagagtttttttgttttacgttaaatttgccaacatagaatagcaatgtctgctgaagaatcacaacaagcacaaactgagactgcagcaccagttccggttccagctccagctgtcgaacaggatcattccaatgaagctactacaaccgtcgaagagaaatcacctggagctgctaccactgctcctgctactgaggaggcaccggcatctgaaaagcctgcttctcaggataacaacggtgacggggaaaaacaacaagaagaaggagatgaggaagatgactctgccgcgcctgttttggctactcaaggtggtagagaaaagtcagataaaatcttatacgttggtaacctaccaaagagcattgatgatgatctattgaaacaatatttccaaattggtgggtccatttccagcgttaaaattattccagataagaacagtcaagagtgtaactatgcgtttgttgaatatttcgaaccacacgatgctaacgtcgcataccaaactctaaatggtaaggaagtagaagggaaggtccttaagatcaattgggcgttccaatctcaacaggttaacagcgatgaaactttcaatttgttcgtcggtgatttaaacgtcgatgtcgatgacgccactttggccggcacttttaaagagttcccatccttcattcaagctcacgtgatgtgggatatgcaatctggtagatctagagggtacggttttgtatcatttggtgaacaagatcaagcgcaagtggctatggaaactaaacaagggttcgaattgaacggcagagccttaagaatcaactgggcttccaaacgtgaaccccaacaaagtcaacaaggtcaaagaagattcaatggtcctgccagtggccgtggtggattccgtaataacaacaatcagaaccaaaatcaccacaatcacaacggtatcaacagacatgctggtccaccaccacatcaccaaatgcaatctcacctacccccacaattgcaacagcaacccccaattggaattcctccaattcatcaagctcctttggttcctcctccagtggatccagaagccgttgaagatatgatgagaagagctcctccaagagttaccactgcgtacatcggtaacatcccacatttcgctcaagaacacgacttgattccattactacaaaactttggtttcatcatcgacttcaagcattacccagaaaagggttgttgtttcatcaaatatgatactcatgaacaagctgcgttgtgtattgtggctctaacaaatttcccattccaaggaagaaacttgagaaccggttggggtaaggaaaaaccaactttcattcgtccacaacaacaaatgggtccaattcctggtcaacttccactagaagaacaacagcaacagtttgaaaatgcccctcagcagcatgatcaacagcaacctcagcaacaagagcaatgagttcattaaaacaaaaaaaatattaattgttccaacactagacatttttcttccatccgaaattgtctgattctacatgtgatgatgacccattattaacttcctatatataatgatataaaccgttattattttttttgtcccctagatttctagatctgtccatcatgtccatgcattattattagatatatagaaattatcgttgccttatgattctttagtgtgtacaaagaggaacggaccttaacgcttactgtcaagtaaattaatccaagtagtacatcctcatctttcttatatagttttgttgttaactctcgtaatcttctttaccagtgaacccaaacccataggcctatacattacatacgtctgtggttcttaaaccaaaaaaatgaaaaaaaaaaagttcaaaaatgtaacgaatgaaagctatataactctgaaattattataggttttgccattgataggaacatacatgcctggaaaagtatcaattttgctgtgataatctgatactgttattgtcaatctgatattcaaagttatcataatctttttactggaaatattttccaataactgaatagcaatagatattttaaagatcatcaaagagtaggattgttatacggattaagctttttacaaatacaaaagtgtgaagagaactaggtttatgaaaaaccataatcagttataaagatcctatcaattaatcgctagtcgtttcgttcaattatacattattgtttgtatgctaaccacgattttagagaagttaggctttgaagaaaagagagttttaaaagcggtactaattggattaattgcttcgctatacttcctgtacaagaacgaatttgatatcacaagagtggctgtttctgttgtaagtaccacgaaagaaattacacaagcagtaagggataaaataatgcttggtcgatgggctccaagaaatgcggagcaagaggagactattgtcagaagaggtggttatgttggaggtttagtgaatgacggtaacacatgctttatgaattcagtgctccaatgtttggcctcgtccaaagagttgcataaattcatggacactattatcctagattctaatgatgacagtcaaaatacaattgatgagaatggagaagaatcagatttgcctaatgagcaatctactgttgagaagaagcctaaagcaacaaagaataagacatatggaaagaggaaaaagatcgctgtacgtcaagcagacaacgagctcttaaaaaactcaacagaacctaatatgcatttcacattggctcttcaggatctattctcaaagttgaatgcgaaacattaccgtaacagaccatggtttaagaccaacaaacttttgaaaactatgtcaaaagctccaaataggaacatcatcctaggttatgatcaagaagatgctcaagagtttttccaaactatcctttcagagctggagaagaatgttgaaagcatatatggaaaaccagaaaaggatccaaagccagtaccacaagatgatttgcctgaagatgcaattgttggacaagaacacctcggcgagattggtgatgtctatatcccaacggaacagatcgacccaaactccgtgcttgcatctggtaggaaattctattctccatataaaattgttactcccttagatggtatcactgccgaaagaattggatgtttgcaatgtggtgagaatggtgggataagatattcagtcttctcaggtctatctttgaatttacccagtgataacatcggttccccaatcaaactgtcacaacttcttgacgagtggtcgaaacctgagatcatcgaaggagttgactgtaatcgttgtgcattgaacgctgttttggaacatttagtagaacaactgaacaccatccaatcacagccagatgtcaatcaaaaactagtaaccttgatggaggataggatcaatgaagttaaatcagtgttgtcaaagcttgccatcgatgatgatgactataagaggatgcatactgagaacatggttcgcaaatcctcaaagtcaaaacaaattttgatttctagacctccaccattgttatctgttcacatcaaccggtccgtttttgaccctcgcacttatatgatcaggaaaaataactcaagagttatattcaaaagcaaattgaatctatcaccttggtgttgcaattatgataagattaatcttgatgcacgtcttccgatgtccaagaagcaagagaactggcacgaatcatccgaagatgacaataatggaactgaatactacaataagttgcatcgcagatttgaaaaagaatttgaagacagcgatgaagaggaggatggaagtgataatggtcaaggaatgttcaatggatcttcaagaatggtggaagagcatgatgttttgaatggtgaattaagttcggcatcgttgtcatcatccgaagacgatattgctgaagtcgaagaggtggagttagatgcccttggaaatacaatcgtaaaaaagactgccaaaaaaccattattaggtggcaatcaagatgtgtctatctccagaggaaacctcgatatagtagatgccgaaggcaactctgagcaagaagatgatcctgaagatgatgatgaggatgaagcttatgaagaagacgaagctgaagaagacgaggaaaactccgaagaagaatcagatgactccttgccaacacctccgcttcctcctacacaaccaattgtgtccagcgttcctgccgggcctttgacatatgttttaagatctgttattgtacattatggtactcataactatggtcattacattgcatttagaaggttccgtggttgctggtggagaattagtgacgaaagtgtttacattgtcgacgaacaagaagtgctttctacccccggtgttttcatgttgttctacgagtacgattatgatacagaaacagggaagatgaaagacgatactgaatacgagaatgaattcaacgtagagattgaaggtgaacctgctgttgatcaagtaactcattgaattttattttgcaatttcacgcatctagttacatagatacataaatatcacaaatcccctaatataatagcatgttacaatcagagttttggaggagtttgaaacgctgtacgtaaacctctttacttgtgagaacaaaaaggctcacacaagattttcctgtgtctcattttctttacccaaatactgggcataccttgcagcttcctcttgttgttgctctcttaaatcctccgcgatcaactcatcaacatcataatcaaattcagcttcgtcctcattgtatttaccaatgacacgcttcttcaaccctgttttcccatcgatttcgaacttccgagtcccaaatccctcaccttcttgtgatgaactaactttaaacttcacaggtgcatcctctttcttcaattttgcatattttgcaagggatccagccttttccgaatctttggcatcaccactgcgtctggtagtcttcttgtccactgaatatgaaccaattcctccaattagcggtagtaatacaacgaaagctaccactaaaagaaacacaattaaatatacaaatgggttcattgcgaaaggcagtactgacgtctagttggcacttttcgtcaagaagttgatattatatcttaagaaacagttgtttccctttgtatgcatagccattagccatatagtgtgagtgtcggctcatcgatctttttttttcaatatagattgtggaaattagatataaacttaaaagacttgaaggaccttttcagttgaagtaggttgagaaatcacagtttaggtacgttattctctatcacgttgagttcagcatacaacatattgaggtgcgaaaactgaatcagtcctagttgctattagcttgaattagtaaatttaccttgaggcttgcgggaacagacaacgttcaaaggaattattcggagtattgaattgatacagtaggaaagaaattagaagataaggaataaatgctagtgaaaaatagctccagggtcattagaagcgtcatttccagacgtagtattgttaccaaagcgatacctagcataggtctcgcaagaactgcaccaactagggctcctgtgttgtcaaaactcgggattttgaatcaacataatctaccctttgttacagtacagcggatgcataacagtatagcagcatcaacagatgggaaaactatcccagaagagattctggatatgcctatcgaagtgtatcacgaaatttctgatgagtttatggatagcttactggatcagctcgaaattctctgtgattatcatccagaagtcgtgcaggatgttgagatgtcacaaggtgtgatgagtatagaagttccttccgttggtacatatgtaatcaacaagcagcccccaaataaacaaatatggttggcttctccggtgtctgggcccaaccgattcgattactatcaaaaggagtgggtttcgttgagagacggtacgaagttactggatatcctaaacaaagagctcagtgaccgactagaaggcgacgaaattgacctacattactgaacgatgtaaatatgatcttgctgctcacaaactgccttacaactatggcatgtccgcagttcaccgttaaggacccaatttcgcagaaacaattcagagatcacaatcaaccaattttactcttatttatgtatatacttttgtttgtttcatttatttatacctataacgtccaaaatataccttactgacgcgattgcacttacacagtccctgacttcttttgttctttatagtctatactttgttgctatataaatgaaatctgtttgactcagtaactttctcttctataaatgaaatctgtttgactcagtaactttctcttctataaaccacatttgatagtctcggtaaagaaggggtcattctgagccagaagcaaacaaccccaatcataacaatcatgacattcaaatcgttcattatcacattcaaagacagcgttccagaagccgacgcttcaaagatcaaaaactccatttcttctctgggtggtactattgtccatgactattccttaattaagggatttgctgtcaagttgccagagtctctaaagattgataaattgaaggatttgcacggtgatgctttcgaaactatcgaggaagataaagaggtcaaagctttataagcaggggatcatattgagaacgtccgagtcatacatgatggttgttccttttttgtccctttactcaagatctttgatcactcgaaatatcgggcagggccctttattcgcaagaacaacttttagattattacaacaagaatagaaaaccggtactgtcgaatgtcaattagataacgtctatatatttgcattcatatctgtaatcttataaccacttctggtattcatatcaacgtcctcttctacgggatatctcttttcatctaactgtgcttatgttcaccttttctattataatggaaaatgatatctaagaacatattaagtgcgaatctccagttagaaagatcgattaagacggaggataagacaaccaaatagggaattagaggtgaacggatgctatatttcggatgcaaggagtgatggatgataaaaatgtggcaaaacacataaaattttgtcaaagacatttgcaattgttgccgtctcatcgcctggatatagatcccaataggttagccattgcgttctattcgttgacagcgattgagctattgggcaagccagtgcgcaaggacttccaatacagtttggattggattagatcgtgctatattgaacttgctgattactctggctttgccatcccgtcttttagacacgctaagcaattgactactataaatttaccaaatacattatttggactaatatgtcttatgttgttgggggatcacgaattctttgatgagaagttgaaccgtgatacgttgggcaaattcatctcatcttgtcagttacctgatgggtcatttacctcttttctggataatgctggatatccatcgaagttcgattcccatgatctgaggttctgttatattgcagtatcgatcctatatcttatcggatgtcgatcagaatcggatttctctcggtatattaacgtttctaagctgctacaatatatcatgtcacgtcagtgcacaatggggggatttggtgactggaacgagccacacggtggatacacatcatgcgcgttatctgctctatctctactaaatcaactacaaaacattcctgcctcgtttaggcaggatactcttcattggttggtgaacagacaggtttctgctattggtgtctttgttgaacaggatttaaacgacgattacgatccggatgactcaggtgggtttaacgggagagaaaataaacttgcggatacgtgctacgcgttttggtgtttaaattctttaagaatcttagagccccaacgttggagtcagcttattgatgttccactgatacgagattatttactgaatcaaactcagaataagatggtgggtggatttgccaagaatgatcaagatgaccctgatatatatcatagcatgatgggaatatccgctctaaaattgatagatgatgagataaatggggtgctctgtatcccgaaactaataatggataacttcaacctgcgttgagttattgaatttgtaacttttagtatgtatctgtacatatttattagcattaacccattggagaagaaagaatacagtggctaattcaagcttctatttacaggtttcttcttatttctttccaactaggtgttattgtgctcatttgtttatacgaacttcttgacgatctcttcataaataccccaagcgattcctgcactaaatgcttttcttgtaagtctaaggctgataccggcgaaaaggttcctgacgctctccttcgttgcaatatgccaaaaagttgatgtaaaactgtgaaatttagctggttccaattgcattcttgttttcacagtatcgaagggagctgttatagaagttgctatcactgcagcagaaaaagcacttgacccatttattaacgtcgaggcataagtcgagtatctattatctgagttgagttttacaacattgctaggcaacagtgtaggaaccaaaaccttcatccgatcgtaaaataacatgtataaccctgcatatggagcatctcttagggcagtagctccaaaacctctaaagaacccacgtaacccttcggttcggaaaatatgtgatgtggcatatcttaatgatgtatactgatacaacgtcgactcataccgcactttaataacggtgataggcattgtaatcaagccagtcaaagctctggttaccgcaccagaaaacatgttctcatacatgtttaactgcggtaaataactactccccgtgctgccggtattcttccctttgctaatcgcttgtcttatactatttaacattgtcaaatacatcgcactaccaacagaagttcgtatacaagacggcaatgcacctctccatagctgagacggggtctcgatgcttttcaaggttttccatagtgtacttgtcttatcctgttgaagtctggtctttagcaagtcaaatggctgaaggataatcgctgacactaaccctccagaaaaccctccaattaaatgggtagtggcccttcgttgctcagacatatgttaacctcaaacgaaacagtttgtatgaaatcctaaacagtcttaataccggatagtgaacccacataccacttcttacaatcaaagctaccctctgcccctgcaaatttacatacattaactattaatcacaaaatttcaaattgaggttgaatctttgcccttttgctctatatttgagggttcatctgtttaagaaaaacggaaagcatgcaactccatagcgtgtatttattggtgtgggtgatcatcttgccgtaatgacaagtattcaatcaactgttttgtatccacactttccgcattgtaagaatcaaaaggtgtctgtggcagaaggaaagtcgaagtagtaacaatttcatgtttattgatccatctggaaatgaacattatgtgtctcccgttgatctttttctctacagatcgcacctcaagttcctgtaacggttctgggatttcaccgatatcgatcgcttttatattagtgttcagtcctgtgccaataagtttcatgtacgactctttcatagaccagtatagagtgaaaagctcatcgcgatgcgatgagctttcctttagagttttaaactcttggtctgtaaatatatcttgaaaagtatcaagatattcagcatcccaatggttgcaatcaattgtgctggcaatatctattcccacttcggtttcttgaaccgccatgacacatgactgctctccatttgacatactaaattcgatgccgttatggcccagtagcattggcttaccgaacggtccattaccgaatatcaagtggttaaagttttcacctgttactatgctgcatccgtacagctgtagcaatcggtttgtcaaagccatccgttgcagtttatctgaccgtttccgaagtaccttatcttgcgcttcaaacggcagtagcctcatcgccatttcaaagttaaaagaatctttcaaatatccatcttcgaaatcacatataaaaatatgtgacatatgttgatcatgtttatcccctggcataatttaggaggtgatactggggttgatagccttcttagcgcctcaatcttatgatgattcaccggttcttttccatattctgtgtttatcttaagtatagaaaagatgaaatttgatcgataaggcaattcaatcattaaggaaacttttatataattgagacaaagcgaaaggagcaagccgggttcgtttgttttcgtgctgcctgagtataccatcatgtctggagagattcctcaagatagacgggagctatacgattccgctatttccttcttaaaggatcctaatgtcgtctcggctcctttaactcaaaagattgagtttttgcaagggaaagggttgacgcaagatgagattcagcttgctttgaaagatgccactggtggctccaaagatgaatctaaaccagtggttaattcagacaatacagtgtccagggaatccagtaatagccacttccattacgaagcggtgccaccggctattccaaaccgtgattggaaggattatttcataatggccacggccagtgttggtttattctacggtgtataccaacttacaaagaggtacattgtaccacagttgctcccagaacctaaatcgaagttggagaaggacaaggaattgattttggagcaattcgataaagtcgaaaagctattatcacaaatagaacaagaacatgaagagtttaagacaaaggaggagaacaaactagaagagttagataggaccatcattcaattgcaatccactttagatgacaccactaaattgaaacaacatatggaaagtgaattcagttccattaaaactgaattcaacaacatgcaaaattccattgattcgttcactaagaaggcaggcaatgaaaaagaattagaaaaagttcaagaagaacttcagtctctcaagagtttgatcaaatccagtttcaatccagcctctgccatgaacaacggtaacactggtgggaacagtttgatctcaccgaatagcaccggaatgatccctggagccgactctattccatcggctgccgatatattagcgaacatggacctgcaaaagaagtcagcatcaccaccagctggttcgctaactaatggcactgatactaaagccgtacctgcttggaagaaggcaagagaagagaatggatcgaaatctgcaactccgacttcctcaatacctgaatggcaaaagaccatgaacactggtaacagttacgaatccaattgaggtggctcaaaatttaatgtctgatcacattcaggagcagctgagcactatcgagctcagcttgatgactctctatatgatttttgtatgagtaccatatatgtatgtaaggccgattaattccgggtaatgatgtctttctattcattttctatggttctgcatgatttcaaaatcatcattccaagcagaaataaatcttaaaatccacaggtactacaattcctattactattgaaacgagaaataatttccttagaggggctgcgaagctaacttaacacatatcactggatctcaatggaatctgtgagtcaattggtaagtaattgtgccagtagaggtattcctgcgcaacaatttctcaacttttatcatgaacttatcaatgaaaaatacggtgctagcctaaatgccggtaacgaagagcgtgagtcggagtccagaaagcaggtgtttgaggatgtctctcgagaacttgtccaagcgtttcattctagtgaagatgctatacttttagcggagtatatggtacatttattattcataaattatgatacatatttgagttcggcgctcttaccacaggtttactcgatccaatcggagactcttttaatgcatttccatagtcttgcagcatctttcattggaaaactagaagacaagttgatcaaagaacaaatgaggcaagatttatctacattcatcttatcatcatgtcttcagtgcgacatgagtactttcaataaccagctctttatctctattgtcaagtatttgcaggcactcttgactttgatagatgatagtattgacatcgaaatggacaaagataatttaaagctagctgtaacttctttgttaacaaggactactaaattgaatagaatcttagggaagcgtattggacgagaatttgagacaaaattaaacctttcactgagtgcaaagctcgctatggtgaattcacctcaaatattctctccttcaagtggtgctacccgctttgcaggaactcctggctctaccaagccgatggatctcgccctttctgctacatcttcaacctccaataagatacaagatttgaaactgatacgattttacaaaaacttatggctcaacaataagattcatcatttcaacacttcagattctcaattgctcgagaaattcagctcaataaattctcggttgtcgtcttccctagcggaagagcacttgattcaagagcaaatcactgatctaattgaaaccacatatacgtcattcgctcagttggttaataataaattatatcatcaaaccaacacaaatttcaaccttcttgaaagaaaatacgttcatttcattacaaaaagattaccattgattatcaaagacttcttaccacaaaatccatcggtaattgtcaactcactacaaaacatcgatgaaaaggttaaaaaagctattaaatcttattattcgaataaaaatgattcccctgagagaaatgaggacttatttgatgattattccgggaacaattttgatattagacatgatttcttgaaaaatctgataatgttgaatctaaggccgcccagtgtattgaacgagttcttgcgagaagatcaaatggtggatgtcaaaacattgaaaacggatgactcgttggtcattgtgaactcacagggcgtgcaagaaaaagtgagcgacgtccaagaagctttaaagtcactaatcgcagatttggacatagaaaaccaatacgttgcaaatggcaataactaccgtttctctccagataacgcactcctgaagcttcttatgtcattcgacactatagcacccaccaagcaggttgaaatcgcaaacgcctttcttcagatactacaaaaggctacagacacctcggacttaaaaacactaggaaaagttctttggatactaacgtcaaatgtgggacattctaccacttcaatgctctgctgcatctcgccaggtccatttatcaatgcagtagttaagttcctagaaaagcaacaaaggaattccacagtatcgagctctgatgaaccagattttgattctcttcatagttatgtcacatatgggatggctctatcatttgttgtttttctgaagactacatatgactttgatattgaaccttttattcaaaatttcgaagaatcatacactttgaagttcctttcttcaattgaagacatttcggatatctttgtgttacagaatgaatcggcagaaggatccaaattatatcttcaaaactggttacgagaccttttcattaatggatcaatcagtgactctcaaatgaagaacaccaatgttaaagatctcatcaatcttattccatttatctttaaacaaagcgtaattgctgtccaggcaggtgttgtgtcaaatattctgaatttgactagcggctttgaatatttcttacaaccgttccttatgccaggattgataaaaattatgttctggttagagtactatctacattctttgaaaaataataatccgccttctcagatattgagttcctgttgggagcttatcaacatattgatatgtccgccttcattagacgatgatgcaaaaggtttgcatttcatgatcttgaaacttaattgcgtcagactgctcaacgttttgtacttattcaggaatgatgaaagtaactccagtcagtatggtgtatacgcagcacatgagtcgattgatcctaagttggaggcagtgatatccaagttggaatacattgcctcaatttctaacatttatgacgttgacactaaatgctatgaaaccacaaaagaagtatactcgcatggtactctgttctccaataaaataccagttactaatgaacaccccattgatattataatgacgaaccaacttaattcattttggaatctacacagtagtacgtactataactatgattatctgctggagttgataaaacttattacgccggagaagtttttagtggattcgataagaacattgacctataaggtggcagcatatggtattcctggtgttcaagggaaactaaacacatcagctattgaacaggtagcaaacttcctcgcttacttcatgattttgcatgatgttcaaacggaagaacaaagacttgcccttcttaattacatagaatctggtgtcattgtctcaaaggaaactgaaactaaacaagaaccagaaactaagttagatgatgactttgacatgttgttcggtgaaccgttcaacaataccttggatgaaacgtccttagtgttttcgcaaaacgagcaaccaaagtcctacagctcatcagtctttcctgtgttgcatgacacttttggtgtggtaatagcagaaatgaaaaagagatatgatactagtaaaaacaatggactcctctccgaagcagcgtatgaaaatgcaacgacatttataagaaaatatgtagagaatttgaaaaattcggttgtataagtattaaagtaactgaaaatagtattatatagtacaatttttcatgcagattctgagtgctctttttcaacctctattattttctgtttgttttcttttgctttaccttccatcacaacttgttgaacgtgttccttctgttttgctctatctctcatccgctcctcaattgtgccgcgaattagtaacctgtacacagtgacttgtctggtttgacccaatctatgagcacgatccatggcttgggagtcgatagttggattccagtctgaatcataaaagatgaccgtgtcggcagctgtaagattgatacctaaaccaccagctcttgtacttaacaaaaagataaaaatgtcaggtttagtttgccaatcgtgaactaaatcacgtcgatcatccaacttcgaagaaccatccaatctaatatgagtatattgtctgtaagtcaaatattcttccatgagatccatcattttcgtcatctggaagtaaattagcacacgatgatcttcttcctttaacttcacaagcaattcatctagtttctttaatttcgctgattctgttatgaatctatccatcgatggcatttcgatataggatgtaaacgaattgttgaaagcttttggagccatttcggtcacaggcagttcttctattggtatacctttttcaactattaacttatgctgcacggaagatgggattgagctcaaagcggaagatatactaggattaaacatctcgtactgtttcttctgcacgaagttgtttgatgcaagtacatcaatattgattggtggtgcagatgcagcgggatgataggccggcgaaatagaattgaaatattcgttttcataaactgatgatggtatctccaaaaggttcttaagaacggagcctgaagtcgagttcttcaaaagatgtagatattttaatttgtcattaatcaacaggtttgaggagaatatcttttctccttcgtcataagcaattgaatattttgccgtattgaaatacccatcattttgtagatcaatcgccctattgataacattttgttctaagagagtcgcaaacttgttcggagaagtgtcagtaagttttgacaagatgaagcacaattgaaaagaatttgctgggtggaatatgttcatagtatgatacaaaagctttgctctgacatcaacatcattattatagttcggaacaacgagttcgtcatatattagtcgtggaaggttataatttattagattcttggccgaataatttacttcaacaaagtcaccctcacgagatagtgatgcgctttcaccaaatgaaacaaaagagaatggagacataacatcagctctttcgaataagtcagggtggttacaaacttttctgaactccatgacaagatttaccaatttctgatccgaagtaacatcatcattaccggcagcattctcgatggcatcatatcctccagatacttgagatttcaaaacttgatacagcttcgcttgtctaaaggttaaatcacataggacatcaatttcaatcttatcaccaagttcggattgaacattcttcttgatacgtcttaacatgaaaggcttcaaaaccatgtgcaaacgacgaagctgttcttgattaagctctgtattagattcagcatgtgattcgatatcttttgagaaccaatcgctgaactcatcatgagaatcgaataacgatggcataatgaaatgtagtagagcccataattcttgcatgttgttctggattggagtaccagtcaataacaagcgattacgacagtggaaactcaagagagttttccatcgagatgattgcgatgatttgattgcctgagcttcatccaaaatcatgtattgccatttcatcttctgtagatagcttgcatctgaaacaaccatctggtatgaagttaccataacatggaatggggcgtctctgccatatcttaaatgcttcctatcccagaactttctaagtgttttacggtcattagcattaccccagtatggtaaaatcttaaactgcggaacaaacctactaatttcgttaacccaattgtgcaaggtggaagcaggtgtgacaacaatgaaaggaccccagatattatagcgatctgctaaatgagcgaggacggagatagattgaacagtttttcctaaacccatctcatctgctaggataccattgataccttgatcgtatagatttgctaaccagtttaaacctttgagttggtattcctttaaggtacaagctaacatctttggttgatcaatagtaatttcccctaaggaagttggattttggaagttcaattcaccatcttcttcgtcctcttcgtcgaatttccttgctttatcctgagtttccttcaaagcgttggaagcattttgagcagccatcaatctaagtttttcatcatcttcagttgcgaagtcaatagattctacatttgtcttagaggcagcagtcttagtaaggtctactaccttattcttgttattcgacatagatgtcagtgaatcatcagtcatcgtaccttccaattcgttagttttaatcttactaccaatgaaatgggagtacaactcagtttgagttaacaagaaattcaacttctttgcagctcttaaattttctctttgttcttcttccttctttgcttgttcaatagcttctttttcagccttcttcttcatttctctttcttcacgttcattcttcttccagaaactagacatctctcttatacctctacgagccctagtttggaaatctttaacttgtctgaaatttctcatttgccatcttcttgcttccttggcacatagtgaagaagttttcctgaaattctgacctcttattgactgaatttgttgtaactgtcttgatatcctaccagaatctcttctagccatgtctttccatatggtaatataggtttgatcgtaatgcctttggatagcacgagcctctttcaacgtgatcttcataccataagtaggtaagtcgtgttccactcttctaacttgttgtggaggtggaggaggaggaggagcaagtttccgtttctttgcttcctcttctgcctttatcagagcctcttcggccttcctcttacgttcttcttcagcaaggtgtctcttgtacttacgaatatgcaattgttttagggtgatcttgatctctaactgtgattcaggagaataggatataactttacagttggtaaattttctcttcatagcctttgcaactgagctcttgattgccatttttcgtaattccttttggatagcaggcattggtgaatcaatgttaactttcttattaactttaaccttgctgatggcagaataagatggtgcgaaatcatcatctccatcatcctctggtgctccaagatcgtcaatatcgtcttctacttcggcttcatcattttcatcctcagcttcttcgtcaacattttcgtcatcagcttcttcttgttcatcgtttggattgtcatcagatccgatagcagagtcatcagcgtcaagcactgaatcatgatccatatcttcattcccctctgtgacgccgtttacgttttctttttctctggcagaatctggagtcaatggagatgatttggttggtttattagatttattacgagataataatgacgttgaagaaacaggtcttttccttggtgcattctcggaatcattgatcgattcatccacgatatctttatctaaatcagcggcagatccgctggcatctttttctgtatgtatatcgtcttcttcctccgcatcaacatccttggacacattactgaccagtatttttttaggcctagatcttcttttcggcgtggtaccaccgttctctatgttttcatttccattttcatcaccatcagttgcatttcggctcctgacggttttggaaagattggagggccttttgaccctgcgattacctccagcaccccttcttctaccgttagtggccggagatttggttggacttttaccgctagtcttaatgccgttaattgctggtgatttcttagaatttgctgtagtctctgaatcctgtatttgttccgtatcagaggatactactgaattggcatcagcaccagatggaattgaaggttcttgctttataatttgaattgattccttcaattctgctattatcgcgtccttctgttctttaaacttctggtactcaacccattccttatgagttttatccatattaacaagtagtctttcacagttgtcctttgttagttctttcccttgttgattccattcgtttattaactcgaattcttgatatgaaaggaacttccaattctgataatccatctcacgatcatcccgttcacagatcttggacattttcaaataccatcgtcccataaaatcagttcgttttgaactgtcgttctcttcacggttcaataacttttcgagagacattcatccaatggtattgtaatctttaatgtgtatttaaaagaagccgccactcacaacaaacgagcctttatctctaataaaagattgcgtttcacacaagatcggttctttctttcgtttcgtttcacgtattcaagaaagacgcgtcctttaacaattggcacaatcaaaacgggaacccacttttaaccaaaacttttctttgcgtcttgcttccgtatctctctctctatctcttgcgatacagttttcttcacttctcctttcgacagatatatatatacccgtgtgttttgtgcactgcgtataatatttcaatataccagatcgtttcacaagagagaaatttcaagctgatttacatataatatacggtctatagaattagtctgattaacaagtattagagtaaggaacaaagaccagtaacactcctcatccttttcttgaaagagaaaaaaatttctttgaaagttgatcacaaggattacaaaacaaacgaaactccttttttctttcaccaagtaaactgtacccaattggtattgggcaactttcactgtttgtcgatttgaaaaatagctaattttaataaagaaagaggcagacaagggacagacagacaggaatcgttgagacaactagatctaaacattttgcagttaagtatgaatacgagaataagtgagtctggaacttgagaattaagcaaattagacacactgctccggctgttttatatgtgaatgttgtcacatcctataatatgttacattagttgatcttggtaatcatcagtaaaggtttggcgatatcattatacacgaacttgaatttcttttgcaccatggtacatggtgctgtgagattgtatagcatatttacattgaggtgggactacgatccaatcacttgttggtgcatgtcatagcgtccctatctactatttggaactagtgaccctatcttggtgtctcattatgttcctccatcagcatttgaagtttttaagtgaaatgttagctttggagatagccattttttagagctgcccaaatcattttggacagctctctcccgaaaaaaaaataaccgagcaacacttcgcagtcatgtgactgtgaattgtattctgctttacccggatatccttgccaccacatcgtccctcgtcgacactcagctcccaaacttttgcggttcaaagcaataccagaaggcatcgtagggaatttctttccgttcttgatggcttttccttagctccacctgtacactcttctctcaacactcggcaaaacctatcggaaaaactgcaaatccaacaaccattttttttttttttaccaatagcatttgtctgaaagagaatagcttgcaaaacaattgaaaaggaaaaacgtcattcgggaagggggaagcgatgttcgaaaaccgatagtatatacacaccaatctattatgagattatctggagaaaccaagttatactatcagtacagtgatgaatattaccacttcagctgaaacttagtgagacaagtgatctccagaattttttttatctcctcagacatttgtgtgcccatttccgttcttcctgtcgtttttcccgattatattaatgaaacgcaagaatgcaaactaatctatcatcagtttttcctactactacagagcaaaagtattcatgaaacattggtggtgggaagagatcagtgaggggtgcagtgtttactgtggagattggcttgtgttactgtatgttctgcgtacgtaaaattaatccggggtgaaacaaattacattattcctccgcgacttgacttctttttttttttcggttaatttatttttcgtgccaatttaattatgtacccatttggcacggctttttgtgaacgcaaaattatcaatatcggtaaccccactcacctttttctttcctatttcttccaggtattattcctcatgtaatgcaaagataggttactcccctctatccggttggggttggagagccagtagtacacatgattcaactcaacagaaacgtcccccgtaaaaaaaaaaacattatgactttttccttttggaaaaacttcatctcgaaaggaacttaatctagatcgataaagatttttttcagtttttactgcggttgtttctggacttagtttttccccatgtcttttaatttctccagtcagttcctgaggcccagccagtttctgtggttttttccccggatcttttactggtgactacaaaggcaattttttttccttccgcttttcgtttttagcgtggagtaagcaatagatagggctttcttatggtattgatccgctaattcaaactggacctatctcgtcgacaaatttgtatataatacgaagagaattcgcttactttcgtccaaattatccaaccccattgtcaaataagaatatatttgtgtacttctactctcgtatttactagatcaaaaaattagaaagctacagtattaatagcatattggtccgctaagttaaagctattagagcgtagaggttgttgatattaaaaaggttaagaaacaatgtctagtaatctgtctgaaaaagcagttgaccagcaaaaagaattcggcttgcttaagagtacgagttctgttgactcggtacacgaagttgaagccggtgtgaaagtcggtgaagatgacgacaattattttttcagtgaagatcaaatcttaacacagattaaggtgtacgaagatgaaattgcaaatactccagttactaagacgctaagacaacgtatgagaagaatggaattttgtgaagtgaacttctcaaataaaacgtatatggttattatgcttggttttttcgcatcatttgcaggtattttgtcaggtgtggatcaatcgaccatttcaggtgccagttatggtatgaaggcatcgttgaaattgacttccgatgaagattccttgatttcctctttaatgcctttgggtgcggtcggtggttctatcttgttaactccattaagtgaatatttcggtagaaaagttgccttagtgatctcatgtattttttataccattggtggtattttgtgtgccgctgctcaggatgttcatacaatgtatgcaggcagattcttgatcggtgttggtgtcggtattgaaggtggtggtgttggtgtttatattgctgaatctgtcccatctaccgtgcgtggttccttagtttcgttgtatcaattcaatattgcccttggtgagttggttggttatgtcattggtgtcattttcttcgatgtcaaaggtggttggagatatatgttaggttcctctttggtattttctaccatcttatttgttggtttattcttcttacctgaatcccctcgttggttgatccacaagggttatgatgtagaagcttataaggtctggcgtagattgagagacacatcggatctaggcaataaaagagaattcttggaaatgaaacatgcagctgaacaagatagacaattgaaagaacaagaatctcgcttcaagagtatgtttgacttgatcttaatcccaagaaatcgtcgtgcattgttatactccattatgatggtctctttgggtcaattgactggtattaacgcaatcatgtattatatgtccacgttgatgggacagatcggtttctctccaaaacaagccgtcgctatgtctatggttggtggtgctgctttgttaataggtaccattccagcaatcctatatatggataaatttggtagacgtccatggtctatgaccattatcggtttctccgtaggtctagttctcgtcggtgttggttatcagatcgatttgaataccaacttggctgctgctgaaggggtttacttaaccggccagattttgtataacatcttctttggtacttatgccactttgacctgggttgttccttctgagtctttctctttggctacaagatcgatcggtatgacgatttgctctgctttcttatacttatgggccttcactgttacttataacttcaacaaaatgaaggacgctttcacatacactggtttgactttaggtttctatggtggtattgctattgttattggtattccataccaattgttgtttatgccagaaaccaaagataaaactttggaagaaatcgatgatatctttgagatgccaactagacaattggtcaaacaaaatttgaagaacttaaaagattacgtttctggtaaccgtaaatctatttaattctctgtcttatgctaataaaactgaatgaagtaaggagttcactttgaaatcgatcaggggactttgggaacaagacattctacatctctaaaataatagtcatctcttttttagtatctaataatgattactcatgaacctcgcatttatctctgaaattagtcctacttttgctcttgtcatcgcgttacccaagttcatttgtattgacgggatgttagtattattttctcttcaatttcacgcttttcactgttttctaggttacgtttctatgtcacgatttttataataatatcaacaataaaacccaatgcattagaaccaaggatatgaactcattcgaacatatcttaaacgcatttgataatccaacagaatagtttttactgagaataaagcctcttgatgcaatatctatatatatcattaatttattaattggtctatattcgagattagttatgactgtgtccgtcgattgcagaacacagacaggcaagtgaaaagggaactaaagtattatatttggagaattcattatctactctcccattgcgcaaattcacaccatccagatccagcatcggagattatcatagcattccatctacccgtttcgttaatctcaatagaagcactccaggttccaaaaggcagatgaggatcattcttgatcactttgtagcgcttacctgttggagataggataagcatagcacgactcaaattccggtccatggattgatggatgatcccatcagttggattctgaatcatttcaaatttgtacttcctcttgttcgataaaaatttgttttgaggttctttaatgtacacttccactctttgaactgcttctgatggaatcctagatacaaattcaaaattaccaggatttccagatgcagttaatggcaaaatcattgaaattggatgaatattctcaatggagcactgtgtacctttgataccagagtgtatgtaaagggtcccctttgaagcaccgggaggaagaacagcctttattactgcgttgcgtttattttgagataacacctgcaccaaagataaattcattgtcttgtattgcaaggaattttcttcatccacaacaacgtttgaaaagacctcaatatcgttggggattctcaaagtgcactcgaaaatttcattatcttcaagatcacataacccattgctgaaccgataaagtcttagcctatttttgaagaaagaagggaaaaccacgggcaaactcagaacaatgttcagatccagttctggaacaatatgttgttttgaatattctcttggaacgtgagtattgatcaaagtcattggagaggccaaaaaatagaacggttcgcatttcttagctggtttgttattcaaatattcatgaatggggtttgttatgttgccaaggatgacatcgacaaatctccattcctcataaaaacagacctgcaaccagcagtggtttaacttgaaagtagagttgtctgcatttggtgttttcaagaaaccaaaaactatttcacttttaatgttcagtgcagtggacattcttttgaacagccacgttagttcatatggcgtacagtatctcctttctagcgccttctccaagttctcaggggaacggttgaaatctgttttaccattatcgtctatcaatctgaagagttcggtacagaatataaataatccccgaagttgttccaatggtgtgaaatattgtgaaggaaagctatattgggcaaatgactcaacggaaagttgaacgggcaacttttcaaagaagagctgtctagcggacttatcgactcttttgaaatcagcgctgtagaggaattcatccacaatccctggctgacgcgtatgcaatacttcattggaatacaagtccttgttgaccactgaatgaggatacagtaaaagatcaacatttttcgcggttgccctcatacctctttctcttctttcatttgaagagatggtaagcgctcttcttagttgagcctcagcttccatccaactatttgcgtcatgattatccgccgaaatgttcagtgattctatattaggcaatttaggataatcatttgctccggggttatactccttcgtatttcctggtaaccatttcttgaatatatcaaatttgctctctttcatgctttgactgcctaacttagatgttgtatctttttgttctgctaccattgagcgatctgtagaatccttgaaagatctagcaaagttatgacgggcaaaactgccagcactggtagcactaaagtcgctcatgatagcaaaactttcttcactgctagctaacgagtcctccatgtatcttgtgtgggaaaaccgaccaaacgaatccgtagattttaatggttgattcattccattggtatagcctcctgtttgtgagatatgattgaataatggtgtcgaaggagactttggaattggaggcagaggaggttggttcggtatttctcggcttgaggaatatttatcttgaaatttccctgtccttttagcaatattggatgcggaatgcgactgcggaatggtatatttgtctttgctaccaaaacttctgctatactgttttccctgtgagtatccagcaagttcctcgttggtatggttctttctcaaagaaaattggtctctctttcgaaattcaggtgatgatgttgcatgctctttataacgttgtggagatcttggcaagttactttgatgcttagtcggaagatatgtattgtattgttcttcgagaattgacacgtagttacttgggaaatagccttgtttcttgttccttatcagtttaccaaaataccaatctcctgttactctggtcacttcaatgaaatcaccctccaagaaacctaaatcatccttcttttcaccagaccaggcgaaattagtcttaaccttgaaagttactggtccagactgagacataaagaagtgctaatcagtagcgaacggatagtaataaaatgcgaaaacaattaatgaatgtgtgaatgaacaaatgaatgacaggtaattaataccccaattattccagttaaatagccgaaataaatgtatgcaaggatcaaatccaagtgagagttgacgactgatcaagcagttaacaggtcactctataacttgagatctgatatgaaatccagttttgcaccaattggtctagaacgtggttatgctgggagcagttgaaaacgaaagaagaaaatcgctaatagtaaacagtaactggccagttagaaaagaatttaatataaattaccaacgaaatttacttcaattgtgtaagatcaatgtttttagatcaacgtttcagatcaatgcttacctttttcggtttcaatgaggatatatattttttctgtttggctttccaataatgtaaatagctaaaaaaaacagatcgccccaagattagatgataacctatcagaaagagaaacaagaggtcagtattgctagctacagtgagggatctttggccaaattattaaaatatagctaggatactgatttattctttcaattatttggtggaagtcagcaaacagaaagtagaatttacgataaattatacatgataaaccattactctaattatgcgaaataagattctatgacgttgtattttgaagtgcaaaagctttttacattgagatattctaagagacaattgagattgcggcttctcttgacttttggattagtacagcatcagccaagacaagggcagccattgcttccacaattggggtggctcttggggtgacagaagggtcgtgtctacctttagcagctagaataccagatttaccgtcgtaggtagcagtagcttgttcttgagaaatagtagctgcagatttgaaaggtacagagaagtagatgttttctccatttgagataccaccttgaataccaccagagttgttcgtctttgttcttagtcttccggtgtcctcatcgaagtagaagggatcgttatgcttagaacctggcaaacaaacgccatcgaatccggaaccaatctcgaaacccttggaagctgggattgagagcatagcatgtgctagcaaggcttctaatttatcgaaacaaggttcaccaaggcccgcaggtagatttctgatgacacacgtgacaacaccaccaatggaatccttttcacctctgtatctttcaatttccttcaccatagcatcagcgacagatgaatccgggcatctaattgggccagcggcatcaactttttctcttgtgatggtattcagaacctgttggaattttggatcctgtggatctctgttcatcttgacagcaccgatttgggtgacaaaggcaacaatttcaacgttggataactgttttaggaacttttcagcaatggcaccagcagcaacacgaccaattgtctctcttgctgatgatcttccaccaccagaagaagctttgatgccatacttgctgctgtaagtgaaatcagcatgcgaaggtcttgggtaattgtccatatcactgtaatcgtgaggtctttgatcctcgtttttcacaagcataccgattggagtaccaagtgtcttaccgaattcagtaccggattgaatctcaacgcgatccttttcatttcttggggtagatagtttcgattgacctggtcttcttctagtcaattgaggttgaatgtcatcttcggttagagacattccaggtggaacaccatcaacaatacaaccaacagatttacagtgtgattcaccgtaagtggttacacggaaaatttgaccgaatgtagacatttgtgttttgttaacggtttactatttctcagcgtttcaaaaacaaatgtatcggatgtataatctcagaattcgactataatgatgtcgtaacactattctagtgtactggattgtgggaaattttcaacaaaggacacacaaggcttttgagtaatccttttgacgtagcttgctgctctgtctgctccgctcatcatgttaatcattccatcaattttgttcaaacttttcaatattgtcgaagatgtgatgaatcataggaatgaagagcaggagaaaaagagaaactcgtggttacccggaaatcattaagatctatacatgataataaggtaagaaacggcagctgaacgtgaaaacagaagtaaagcttgcatgtatataggataattgaccgtcaaatcgttactttctgcaagtatatgagtaccaatattctttcagtgcaaggcagtaccgttttaagtatgctttgagcaaacgctgcttgcttatgttcacttcaccagtaaatatgtgtcctagatcatctaagacgaatgttgatttcttaatatcgatttcatcaaaatacttagctaaccatataatggtattcactgtttacgattcactcatcgtggatatgttaaaagctggtataaaattgagcaggcggtgcatagaagggaatccgaactgcgaacttcggcaataaaacgagatggacgttgacttcaaccgttcccaggaaactcacctgaagttcggacaaatcttgaaggaatatcaggcaagagtgttgagcgatgaagcgtctcttgacccgttctctatagtgcaagacttcaggtccattgccggagaagaggcattggaaattgcagaatctggagaggagaatgataatgaacagttccagaactgggaactagaggccaagttttgggatcttgttggcttgttagtggaatatcgaacatcagagacagttgacaaagatattaacgttcattcatacaattcgaacgtagtattccaaaaacagttgttgcaatcaaataaggggatatatgaaatctggttaataaagtcatggcttgaggctaacattggcatcccagagagaccatctagtttatgtactacaaaatggtcgagttccatgatagcaggcactgtgaaaagcatggattcggattcgatcttaagagatccaacaacgaatcttcagcctgatgatcgtcaaaatgatcatgctttcttcgtatatgcgttccgccttctcttggctggtcaatttgagaaattgacagaagagtgtgaatttacagataatttaactcttaatcttatactgagaggaatggaatcctatgtggatccaaacgtcgatacggatatgaccgacgaatatgcaagtcaacaagggattaaaaaacatgccttgtggagaagaagtgtatatgccttatctcaggatcccttactggatccttatgaagccgctatatatacctatctttcgggcgattctcctacaaatttgaggatagacgggctggactgggaaactgaattgctaatatacgtaaatcaaatttggaatgttaccatggaaaactatttgatagaacatggaagagttgacaatgatgagttgatcactgatatggataccgcttgtccaagtttatcccaggttttgaatattcttgctgcaaaatatccagatgagagcgagcatccgattagggtgttgactgcatcagtacttttgaacaccatagaaccggtcatgaaatcatcgacagatatgctattggatgttattaaagggcgagatgaagacaacgcgctattcaacgaatcgtacttgctaagaattctcacaaatttaaccatattccttgatattgtgtcaccagataccatagacatttcaaataagtcgaaattattaacatcatacatctcactactatcctactatgggttatacgatgttataccagtctttgttagtttcttatcacaagaggaaattgtagaaacttattcattcttcctcaccaatctcattgatcctaatctcagacaaaaacaaatggaaatctccaaatatttgggtttaccgattgctaatatactcagaagaaccgctcagcgaatttttgaagaaacggatcaatattacattgttgatagtgacatagagttgactaacgaagttagtgaagtggatcaaaggttaatgaatggtgttgaatggctaattgagaacggactctatactgatagtattgatactataattgcgttatcgaggcgcttcttgataaacggtaaagtaaaagcgcttgagttatttgttgacaaccatgatgtacccaatttgttaaaagaatatcagttagaaaggctatcttcacaggaagaggatcatgatttgaaaactacggaactcttacaatatacatcgttattatctaccttcaaaaagcaagaagagtgggtaaaatcatcgcaacttttcaataccgagtcgaacttgcgatccctaattaagcaattcaaaggtttctcgaacacaatcataaagttagtaacgacatttttggtagacctgatagacaatgaagaagtgaatgattcagacgttctgtatgaaatacgggccttatacactccatttttgattatggagttgcacaacaatttgatttccgcatcggagaacttgaaggtatctacattcgttcaagaagccattgacctctccattttggttgccaacgaaactgataagatatatctgttattccaaagtaacggcaaacttactacatatctacagatggttgcaaaggcatccgcattatttggaaggtaacttagaaacagaagttggagtttttaagcagtacatataatattaattatgtatatataaacatatatgtaagcgaaaccaatcgaaaaaaaataatagcaacgacattaattaattgtaattgagattagtttattcttcttcctcgattagacccttttcggaaacgtagataccatccaagaacttacggatatccttgtttctgacacgacagatttgttggatgtcagcagcgttttgggaaacgttttcgacggagttaccagacaagacaatttcgtccttttggttggtggagaagtcaacagaaacaccatctctgactggaacttctctgaccttcttgtcacccaagaagtttctgatttcgatgaacttagcaccgtccttttcaatgacgttaacgttgattgggaaatgcgcgtaaacgtatctcaacttgtacttgtaacccttggtaacaccagtgatcaagttggaaatcaaagacttgacagttctcaaagcagcaacgtgctttctgtcaccgttgtgaacggtgatcttgatttgtctgttagagaccttggtgaaggtaacatcgatgtgcttcaagttcttagtcaaaacacctcttggaccagtaaccttgatgtttctggatctgatttggacggtaacaccttctgggacatctaggacttggtcagtttgaatgtacttcatcttgtcttgttgtattcgctcacagcctatctgaaaaccaaaaccaaaacaaagcaaatgcactcaactgtaatactgtaatactgtaattaacgcctgtttcaacaaacaatgcaggagccaagtataactgggaatgcttgcacatcatctttgttaacctagagctttgcaattggtgaaagttggtcaatcttgcagacgcaggaaatgagacttcagaaatttttcaccaaacacccagacatttcacagtatcaacgactttttctgtggaacctagcggttgtagttctcatctcaaaaaaaaaaaaaccgcaaaaattcctctttggaacacctgtacataatagaataacagtcccgcagtttttcaatgatccattccccatcccaaagaatatctgactcacaacaagggaattgtgtcagacatccaaaacgaccaaattaatcacactttatctatcatcttttgcagcttgccgaatatacgatctctgtgtatagcatcttcatcgtctttgtcagttgggaagaagtaatttctcttgaatgtctgatcatctacgtccattccagtatcgtgatcgtcatcagcctctggcttcaaattgacaaagtcaccgtcgtatttaccgttgtcattatcactatcggcatggtcatcgtcgtcgtagtcaaagtcgacgtaattattggcattcaacgagctcaaaagattggaagattctccgtaattttgaaataatgcatcaaactcatcaccattatcattggtggtttcgttagcctgctcaccgtccacattataattttgatccagttcatcatttaattcgtcaaggtatactatatcttctgaatccgtcctatcttcgtcacttccaataaaaattgatctgtcatcgtcttcatcttccggataatcgttctgataataatcttcctcatttgaatcctcatcgtcagtcaacattgttttctctggatctacttcttcttctgggatcatgtccccattatgctcaacgattctgatgtatccgatagtactcttatcgaaaacgaactcctcctcatcttctggtatggtttgtttcacatacacatcgtaaacgtaatctgtaggaggcaagatcggagctgtatatgattttgaatgttttcgacttgccttgcgtttcttgtgctctggtgagtccttctcctttatcttaagatagtcatttagcatttccgcaatgctatccggtagctcttcttgcaattctgacgctgcctggcgctcccgttccctttcaagaacgtaaaccatttttttatcattgttctcattactcaatttcaatagtggactgttaacatcgggagtctcaagctctacagtcttagatagcttgaacacgaacttccctttttttgcgtttctctcctcttctaagagcaaagcctgtacggaatcctcatcccgacgtcttttcactctgatgtactccacgccagatatgcttttactcatgtcagatatatttgcttctgtaggtagaacagagtcgtttctgctatgtgattccctcattaatccattggtcttggatcaaatgattcttattctaagttgaaaaggtaaatttggttttcctagacaaaatgattctgagcaaaacatgaagaaagttggaaaattgacgctaagaacgtcaattagtgacagtaaagaaaacgatggcaattagagttggtataactttcattggtcatagtatagaatagtttttatcagagaaagggtctctgattgtagctatgttttggaatagcttaaactattttgcgttggatcaaaaaggtactcaatatgttagagttcttgaagatttagttacctcttttgtgggtataccattgtgtccacaaaaggacattgttgtagttgctgggggctcgagaggtattgggtcacatctcgttacaatgtttgattccttgggctataagactattctcattgataaaagatacccattaaatcttattgaacctcatcgagtgtcattttacaagtgcgatatttctgactttgaatatacaagattaatcttggatgatatctcagtaagatttggtcaaatcactgtatttatcaatgcggtttccttgaaaagttttactgacgccgaagtggggaaaggtgtgagtttgagaaagttaatgagaacagtgtatgcgggcagcatgcatattattcagcatattttacctaaaatgatagcgtacgatcgcggttatataattgacattgcttcaacggaaggcttatacactacggaaaataagtcttcttatggtgccatacaagcaacgaagtttcaattactccaactgattgaacagacgttgaaagagcaatataagaagaattttttgatcagcaacggccgagttcgctgcttacttttgatttttggtaaagctcttaattctaaaccgcaccaggatatgacgacggctaaaactgttttcagtgctatctttcataatagacaaggtgttcagggatactcgatgaggacgaatttcaaattagctctaagagaattggattggcaatggtatcagatgttcaaatatttatcccccttcctataaaacttttgccgtttatgaatatccgttccttaatgccgctcttgttgagaatctaaacgcgggagggtggaattcatatatgtaaaatgtatatattcaaaaaaatctgttaattcaaaagctgattatgcttcctgaatgcgattatgtagctctttccatatttcaagatttctagtggcattctccttcatatatttcgcataattcttaaagatttgagtcaattcttcgtcacgttctttaatgaagtttggtaattcagtattctttagagtttcagaaataacgacgagatcactagtagcaactttcaatgtttcatctagttgtatcaactctttctctaaggatcttgcagctgctgcaggatcttgttcctgataactgacagagtccttaattatgattgcaagttgggtaaacttatttatgaattttccagagtagctttgtggtcctgcagggttttctagattcactgctccatttgtaccaagctcttcctttaccatattgtctatttgcttgtggtcgttttcttgctgttggaacttgatgagttgacctcgcttgtaaagtattgtcctttctaagatatctttttggatcaactttaaccttctataatgaattaaatcccgcacagcagtggccatgtgggcacattcactaagaggctcattaatgttgtaatgcaaatttccgacaagagtttccagaatttcttgcagagtcccatatgcatcactggagtgtgaaagtaattctgctagtccactctcgttctttgtttcgtcagttgacaattgtgcaaactcagagctgattcctttcaaatcttcccgtaaatagttcacctccttggtagtagctcttgagtatttatacaaaccagaatgtatcaattgttcgtaatttttgaattccgcttcaattttagtgaactcatcagcgtccgaagctgaatgattgtcctttgatgccagcagttgtgttgatgatgacggtactggcaaatatgaatgtgcttttgtagtgtttgtagggtctattggattgcactgaagaacacttttcggtaatgatgagatagtaagagagcttgtgattagatcgttccaatttttattgttcggatccaaaaagtcgtacacgatagaagtctttgttatttcctggtttttcaagagtctgttcaagaaacttgtaagcatcctgattctgtgccgtatgagcttctcatcattcgtggtaaccggtccgttaattactgatagcgaaagatctactgagtctccgctttccgttggtaataggtaacttgatttagaatatgtcattgcttttccgtaactcttgagtgattgcttttcaggaattggcgggatcaaacttattggaaataacttaactaacactttccgcaaactctcaaaatcgctgtaacgccgcttcacaattgaatcaccatatttgatagcgtaagcgatatatgttcttccctgtccttcggatactttacttgcctcgagtatttgggcccttttcttaccttcttttgtcatcccgctcgcgttatggtttaaggtattatatggcacatctggcgaactatccttactcgtagctactgagctcctacgccgttccttactattttttcttctgtttggctgaagaagctggtcctcgttatcatcacttccggcgtttttggcattctcatcatcgtcatcattctttccattctcatcacttccgtccacgttatcctgcatatagttgaaaaatgggttgtcctttttgataatctgggtatgtattacattctcatgaggttgatcaccgttctggttcgtgactgcagtgtctttgggagatccgttgctttcccttctcatctcgctctgcgtctgtaaatcaggttcatgctccttatgctcctcaacagtcttattgtttttaagtcttgaaggactgttattttctaaatgcgttactgaattcggcattggttcaaaatttatctgcataaggtcactaaatagctcttcatatgctcctaattcaaccctttatctactcatattgaagttcgtgtcaattcataaggggcgttttacatgtcaacaagttgtaacttaactgccatgttcgggtaacagtcttctcgatttctaatacgtgtttcggggcccaaagtttttctggcgcagcccaattgttcatcatcaacatgcatcttgaaaaatcatttataccattacggttagttaaatcgatctgaccagatgagatgcgatgagaccagataaacttaattacatgttatgggaatgtatatagttttagaacctgatttcaacgtaaggatttttatatcagataatgagccactcaaggcaaatcttgggtaggtatatctcgccctcagtacaagaagagattctttcctcactcattgaaactgaagattatgaaggtattagttcggtgctaagttcggttgaactaacagaagatgtctccattaacactggcaatagactatctatcactcttggagaagtaatcgctaaacatgtcaatgatgacgatggtttgcgagttgaaaaagatcaacaactaattgcattgcttaagctttgtcccaagctaaagcaaagcaataaatttatgcatgattttctaagttcccatttgagctcattcatcctttcgcatataacaatgctatttgatgttgaatgtcaacaactgattagaatatctgggtttattcaagttaactcgctcgatgacggattgatcttagatggaacaaaactgctagacattcttgaagtgttggttcaagggtccgcttcaggatcatataacgacctcatcgccaacagtgtcaacattggaaagctactctttttactttcgttatcgaaggatgagaaactttcaaatgcggcgacttctttgttcaaatggtggatcccatcgttcgctacagcctgcaaagaggatgagaaactagatataaccgtatggtctcttttacgtaacttgcttaccgaaagcgcaccaatcacagttgcaaaaaatggctatatcttttgtttaaggatgttaatggaggatggattctcaacaacaagtcaaagtttcgcccaatcaaaagattactggaatttaatacaatccggactaaaccaggaggttcatgaaatcaagaaaattgtgctctctatcatgaagttgagtctccaattacttgctcaaaataacttacccatcctaaccgatattatccaattcagtggaagtaggtctgagattgaatcatggaaaaagtttaccaccttatatgagattgtcgggattgataccgctttgaatcagtgtgaggcggctgcgccagatatccttgatatttttggagatccaaatgttcatgctagttggggtttaatcattctatccaccggtttaagagcaactatggaatcggtcagaaaattcacgcttagactgatgctacaaatcaagcacaaagctgtattcaatgccaatacccggttattatgcgatgtgttcttacctgctacaatgcaagcttctttcttcaacgttgctgacgaacattgtgaatatggagaaagtgttgcaaattttgttgcggagatactactaacgtcagatgataaagggaccattctcgagctgcttttgaatgccttatacgacttcaggaacatgtttgacgcaggaaggatttacattgcttatggagttctctgtggtgtagaaaaattgaaagaaagagtttttgaaactagacacattgaaataatcaggatgctgttcctgtgccggtgtgaagagaatatcttacaaactactattcaaagcatttacttgaaatatatgctattttccaacttatctgctcctgaatttcttcaaacattagccatgcatgtcaagagtgataacggctatgaatacatatccagaacaataggcagtttccgtgacttttgtattgtcaactataatcaatctttagaaggatatgaagttccacaagacgcattgtaccaagtacttgcctatgaattatttgattgtgagccttatgaaatctcggatcaatttttgattgagatcgtcaaagcagattgtaactattccgatttatcagaagaatattatgctttcttaactgagttagtgacaatggaaagtaataactacaaggaagctaaagtcattttggacctaccacagtttacgccagctgtctacggtgccattaatcctctgccaatttttaagagcttgttctccgagtttttacctgataaattcgacttttttgtatcattgtttgataaggttatgcaaagtccttctcagatcaccatatcctttgaaaatttgcttaatttataccgcataattggggagtacataagatcagaaaacaatcttcctttcaagctaaaagatgaaatttatgcaaatttcttcaagttgctaagaatttgcatcaaatcatctcccctgactgaagaacagctgaatacattattggatctcttgcaagaaaatgccgaaagggataatggaaattatttgggaaatcttgaaatcagctatctttgtcaatcaatattagatgtctacattctcccaacactgcatgagcttactgatatggagaaacatgttttgaatagtgcaatgggtttacagtgcagaatatgggattctttaatagaagagaggttggtactcaatcaacaaccattgcatttggctctcataagaggcatcttccattatacgacattcttatctgccctcaatgatcaggctattttcaagatcatgcttcattacgcaactgccattttagatcaatctttttcgaggagaacattgaaaccagttctcagccagcaaatcttagggtttatggaagtgtatggaagttcactaccaaaccagcaatattcggactttgctaggttgctatctgatgttttcactcatgaaagtatgaatctcaacatctacaatttaaaacctgcaattgccaagctatttgattccaagcttggtttatatattgacggaggattatacaagtttgtttatggtgcaacagaagtggttacgaaatcacgcataattaaagctcttttatattcaagcaaggagtttagacgtcaatttttgcaggtgatgctccaagaagaccctaacatgttaaaagcgaagaaaaaaactgatggaccagaagaaattcaacgattacaaaaatggcaactgtgccttctatcgatcaaatcagtcgataaagatgttctaacaggtttgtgttctgattatatcattccttctcttgtggaagaatcgtctccgttagtaagagtttattcagaatggttcattgcatatgacctatgggttacagcgacagataatcataaaaatccaaatgaggactttctgttcaaacttttagaagacacctctcgtcctgttttacaagcaagtgttgaacgtttgttattcttatctttgaaggcagcgaaggagacaggtcattttttcaggccaatggaaagatttgtcgcacaactgataactaattgctcctcaaacaaaccattaattagacatttctctaattccctcattcttttgttttggccaacctttgaagatgacatcaaagataatattttgcgatccattatttctaagctatacagcgatgctaagaagatccaagtacaaggtcaattcagagccggtgacgcaaacacttggagcatcaataacgaccttaagttaacaagtatatttggcggcgtattattgaaaattatggatcataaagttccatatataaatagtaagatattcaaagccattaacatcgatgacggtgaatttgaaataggatcggaagagagtgaactatggttgaccaaaagaagtagtaatctagtaaattcaactgagttagcaaaaaactcgcccctacaaacgaagagtggtgcttgggaagctgtcttggatttcgataatcaaaaatccattgagtctgttgcacgatctgaattaattgtcgtagcttcattagtggataaagcacccaatctcggaggtatttgtagactctgtgacgtgttgggtgtcggtactatgacaattcatgatattagagtcaaacagcatcctcaattcaaaaatgttgcggttacagcggaccgctggatgcctattgaagaagttcctgtcgatggtataatatcttacatgaatgcaaagaagttggaaggatatacgttaattggattggagcagactgattcttccattcaactgaattctgaatttaaatttccatcaaaatctgtcattttactaggaacagaagctcatggtattccagggcatttgttaaaggagttggatttatgcttagaaatcaaacaatctggggtaataagatccatgaatatccaaactgcaacagctgttatcgttcattcgtactcgatccagcatttatagatatgcatttataataaacaccctgaaaagtacctatttactatttaaatgttccttaatctgaagcatccaaagctttttcaatatgtggtgcgtattgacgaattaacttgaacgcttgttctaaatgatgctgactgaaccctttgatattatcgttattcaagccaacagatcttatcggagaagtaaccttatctttgtaccacgtaattagaaggccattgttcgatactatgctctcttcaaaagttggatccacaaaaacaccgtctcctacaattgcgaacgtaaacaataaaggagcatctgcctctagcttaaccatatcgtaatcatggaatgtgggtagctcctccacttctaagtcatcgtcgttcgatattagtttcggtagccatgtgtttttcaaagcgctgaaaatggcgaaagatatcattgagatcgggtatgatttggaggcaagcaccaaaacgtcaatgtaaagtttgaaactgtaccttttcgtgagcattagctttttctgatcaatagtttgtttgagcaatttggataatagtgaagacatgctggtaaccaatggagagtcatctctgtggccttggatgtcgacatcagcaacaagcaattcttgttctaccgtatggtccacgactttagtttttacactcactatacactcgcttcctccgcttaatatcacacggctggatccattagaattgggaaggaaatcagtagatacttccaatggtctaaattgatgtggacctcttccatccggtcttaatgggggatctaatgttagagaatcgtataggaacgatttttcagttaacgaaagtcccattatcttcttatattatttgattttttttttaacgagatgggtctgcttcgtgagaagataactcgctttaaactcagatgtttctattgctgttgatagaagggaaataagccttttctcatcatctcattgcatctcatctcaagctcatataagtcaatactgaaattagttcagatttttcatttcttcttttcgctaatgcacattaatattcggtgttacccggatataattggccattagtgagatgttctgtcaggtgtcagtcacggttcgaagtactaacatacgatgaatgctgactgactgatattgaagttgtactgatacagggtgctgatgtttaatatatatacaaatacatcaactgttttatggacataattattccttatcttttgattttatttttgttcttggtcggttgccctttgctaacgattctatacagtaagattggaaataccagcaaatgacatactccaatgatgcagaataatattgtgacttttgccagtagataagagaacgttgattcgttgagatttctatgatcgacatctaaagcatgcaattcctggccagaatccgcactgaccaacgaaaacaggtcatctctaccctgggataacaaattgagatcatcatcagtaatcaaatcccacttctgtttctgaatcagatcattagacgtgatgctaattgctacttgcttcacactatctatggcattccatgaggagtctaatgaaaagttgataaggcatatttggaaattctgatgttcgtatacgctcacgtaaagcacagtttccccattctctaaaccatgtcttgactgtaccaaattttggtcttcgtcataaatatccatgttgacaacctgttttccctttgaactcgtagttggaccaaacctatccacattaactttccatttagtaaattcttcaatttcaatgaggaattgtaaatccttggccttaatattcgtattcatttcgaaacaagtttgataactagacgcgtcactcgagccgtcaacttcccattttttatatggccacaaatcgaattctaatcgatttgggtttatcggcagtttaagggtctccgagacaactgaacatatcagtaaaaggacatatatcaacgatatcaccatttaaacaaaaagaacaaaaaaattactagctggaacgaaatgaactgggtataataacaaacgaaaagaccacaatctaattactgaagcgaaagctgtggattagacccaaaaaaaaaattttgtctggccgaataagaacacaaaaagatattgacaacacgtatgaagcactgagaaacaaccttaaagggaaaaaaagaattgtttcgatttgaattgaacctgatgctttatagatggagaccaatcattaacccaggcagttcccacttttccaaccgaataattgctgtcaaaacgactctctgtatgtttttctccaaaagtgttcttaacattttcatgccatggcacagtatatatgtcgatcatatcaaaatgaaatgaaatgttaacgtgaacctgatagacttttttcgcatcgacgtttacagatggaagaaaatgaatgccacagagaacggcccagcctgctggaaacagaaaaagctaaatgttaagaatggtctgtagcagattcattccagggtttttcccagcagattaccagcccgaaactaagagaaagaaaccagaacgggtgcgtttattcatctctgaaagtatacagttttccgaggtcataccagcccacacttttaaacatgcatttttgctttcattcattttttttttactatacttcaatatatgagtacattatatatattttgtttggaatgggttcataagttaatgctattggaaccagtggcatcagcagtattatctgaatccacgccaacggttctccggccttgagattgcaaagatctttttaattttgtggacgccgattggatgtcaccggaagatacagtgctagccctgtgctgttcttctaggtccaaagcttgtagcctttcgttataattatccaatacttttccattttccgctaatgagtcttggaatacttgcaaatccttctcatcaatatcatcatcggaaaaattcccttccgcgtccaattcttgtctgttcaatacctcttcacccttaagcttggcaacgtacgcttctaaccttctgttagatctttgtaaatgcttcactgcattattgatctcttttctgatctcttgtaattcatgctcagacgattctctaatagcaatcacgaactcttgaatctgaattggtctacgaataccagaagaatgtgccatatttctatgttaagtctatccttagctatgtatgttttttcactttttagtcttgtttcggttggaaagtacgagatgaattaagatcggtatccttaactatatattcaagctagccttttataacaataatttaagccagagtttattctcttactatttatacccaacggtaagatatcacgccccacatatgacacccacccctccgaggcaccatcattgcaaatcagagtgtatgatgcgcacgttactatgctgactttttccagctccaaagcaacactacttgttaaaaatcacatcagcttttctgctttcctttctcctgggctggatttccccgcctaagtccttctctgggaactgaactttgtccctttcagcaaagagttgagaaactcacgaggaacacaaaaacaacgagaattaggggccgcttatgtaattcttttcatcccataaaacagaaaaattgtgctgttttggcttccacccatacactacgcacaatcaggggttggtgcaatttcggatatattacccgggcatggtgaatttcatcataggcgttacagagtgaagatgtgattcagattctatatgagagagagttcattgcgatgctagagaagagatggacaaaagacaaatggtgatgtgtaatagtaactacggattgtctggaataatcggccctttgtacaaaaatcatatcatcatataatgggcaatgataataatactaatagagggttaaatcggaaattgcattctgcattgagtgttgagaatgtcaatttattgagatttcaaggtagacgttgtggaaacccatacttgcaagacgtacaggctcatggttttgagccaaaggcaagagtatcgtctcattggtatgaaccgggagaggttgtccagcatgctgcaaaattaagacaagagaaccgtgaaaagtctgaagaagaaagaatacgatgggaagctgaactggagaaacagcaggaaatcgaacggaaaatagaaataggggaactacctgataagcatgaagaagtttattttaccgatttatcggacgttcctgatgtggaatggtgggatgttccatatatcaaagatggtagcatccatgagaaatatagtttggattattccacattgaattcggacgatgaaagtgatgatgaagaggaagaggaagaggaaggtgcacaagataaattcccaagtattaggtatattcaacatccggtaccgattgaaaggcctagggcagctgttccagtggcagagattttcttaacgaaaaacgaacggaaaaaggccagaaggaatacgaggaagttggtacgacaggagaaggaggagaaaatcaagcttggtatagaaccaaaaccagagcccaaggttaaattatcgaatatgatgaatgtgtatgagaatgatgccaatattgcggatccaactcaatgggaatccatcgtacggagacaagtggcagagaggaaaaggaaacatttcgaagaaaatgaaataaggcatcaagaaagcctgaaacgaaggaaggaatcccagttacaagcacacagcaatgatagtcctctagaatacacgtgtgttgtttacatgtttgacgaaatacagaatcctagtatcagatacaaaatcaaaaccaacggtaagcaattgaagttgaaaggatgctgtctacacattcaaaatggcaaaggtataattgtagcttttggagatgaaaaatctatccgctttttcgataagttggtgacaaagcgaatcaattggtcggaaccatacaaagatagagataccgaagagacagtaccttgcgacggtaaaattacaaaggtttggcaaggattaattggtgattgtagattcaagggctggttcatgctcgattgtaaagataaaaaccagttaaataatatcttagagcagcacgatgcattgacttttgtaccattaggtaagttttaacaaacaattacgtactgaaaatgaaatccaagttcgaaatcatcaaaattttggaataaaagtaatagtgtatgttaaaaaaaataaaaccggagtaaatccaacgacctacttagaacatttatttacatggggtgagtaggcagtccaagtgacgcacaatggtcaacattattgagttttatcactaccaacatcaaaaaaaagtcatatttatataaataatatctcccttcgtctctcaaaattcaatcatcaataacagagaaagatactggctcataacatcgttctttaaatttaattctggtgtaacgttcgagacctttattcgacgaccttggccaagatttcagagtctctgaataaaacgacttcatcatccttgcccaacttgattgtggatccaccgaattgtgggatcaaaacttggtcacctggttggacagatggtgtaatcttgttaccgttggaatcggtgaaacctggaccagcagccaacacagtagcttggtttaatttctcaacgttcttttctggcaagtataaaccagaagcagtcttggcttcggccttgattctttgcaccagaacacggtccaacaatggaacaatagatttagcagacttcaatagagtggacattttgacctattattatagtgattacttcttaggggaagaatatcaatcgaggaggatcaaggatcttgtacaaacgctgactttgatataatcttggcactctattgttgaaaaaatgtcgaatccttcattttgtaaagtgtgtaagctttatagccttttataaatttcaactttcatgtcagaaaggttcccgttttcggtgatgctagaaaattccatgtggacagtaaactacaaactactgaacatggcaatgatgcgggctaaatgactagctggtagtgggcgccgctttggagttgtcaaaacaatatatagagcttaaacaatggtggttcacagcatgttgaagtcacaattcatagggccttatgttgccggaagggggcagtaagggaggaaaggaaaataaaatgttgtccacgtgacttacaattttttttcatgaaatttaatcactccgaacgtcttttggcccaagttttcgaggtgaaattcgaagggatcacacagaagatgtcgcagaatttcactcttttcgcataaagacactgaccttcctcgaatgagcttttaagaattaaaggatttcgttccaaggttagcaagtgttatacttggtttatgtgaatttttttaacccttcaacaccggttagggctgattccatttcaatcataaaaactgtaccaaacactacaatttcatacatattaataatgggtgctgcttacaagattttcggtatgactgttcaaccacatattttagccatagctaccttgggctctgttttcggtggtgcagcttacgccatgtctggttctaaggatgctgaaaaggccaagccagctgttgctactccagctgctccagctgctggtggttccgacgaatttgacgttgaaaagttgttgggtgatttcttgaaggaagaatccaaataaattcaataaagatcaggtatttgaactaccccccttctatagatgacgattttttaacgatattcaaaatgaaacacgacctcctacacagtctcagtattaaaacagtttccctttttttcatatacatatgtacatgtaatctgataattataggatacttaaaagttattacattgatttgtgtttatctcagaatagatcgtctagactttgctcggaatcttttttgattaattggagcatcccttccggtagaatcggctggccatcagagttgaatacatatctgaatggcatttcggtagcttcgttcttattgaatctgaattctgggtaatcgatgaacttaacgtcttcaaatttagtttgtttctcaatgatgatttgggtggttctgatggccgtgtctgtagtcatttgtttgtcccctagtctttttccgacgagtaagtttgggtattgctccataagttctctggtacggtctcttggtggatgatctccaagaatacctccgaagacgaaataatcataattttgagcatcggatggaatcaaatcggtctttgcccttggatctaatagacagactctttgagattttagctctggtaattctgggaacgcttcattgattttatcaaggttcgcagtggtccactgcaatcccatttccctgagcttctttggaatatcggactcaacggtatcttctggtaatgacgaaagaattaagttatccttgccaatatcacgaatgatttgagcatactctaaagtaacccactcactgaatccttgctccatgtgctcaataatgtacttcatacttaatttgcttgctcctgtattgggtcagcttcttgatctttctgctgtgctcatcgcaataatctgtcgaaggttctataaaatcgcatttgattttccatttttgtttcgatttggcaacagtgcatttaaatttatgagctacgctgaaaatgaaaaagcgacagatcaactgctcgccattagtgttagttctcaacaagactatacatattttatacaatgttttttataatgctctattttgtcttctttgtctctactttggttgattttaatttagttatttcatgagttttaggtttaacgtgtttcttcaatatttccttcagcaaaaatcctgcagtatccatgtcttcaaaataactgacatgagattttatagcactccagacatccacgtctaataaattgggttggaaagaatagtcaacacgcccgttgctgttaaagcgcaacaaattcgaaagtaatcgttgggtcatgagttctttctcttttagatttttatctgacatcaaattcttcacggtgtcagcaatgaagtcgtacccggtcgcatgcggaatccattctgcttcataattagcagtgactttgtctattagtggttcaactcgataggaaatcggatcacagggatgaaataggttgtaaaagttgttgcatgcgggagtttgctgtcttgtagaggaatcagattcgccaattttggttctttgtataagtttgaatacacctattggcgaaccaatagcgaagaagttatcaacttcaaaattcaacggaaacttagactgttgagaaagaatatcaaacaagatgacggatccgagagagtgacccagtaaactgactttgccatcgaattcaggattgtgttcacgatacttctcatatacatcgttcaattcatttgtgacgtgctttaggattctatctaggtaaaaatcatcaccgtatagcaaaatgtccaagccaacgtcacccaacaactttcttaaaggtctaatgccgtctaccgtcaaatctgctaatgttggcaaatcctcattgtcacgattcgtattagtctcgtctgtattgaatcctattgcatgcctccacgtaattggaagaacttgtgttccactattggttttataatcagggaactttcttgcggaattgaactcctgtaaggaaggattcgatttatacaagtacttgatgttgttccgtaataggtttacagtatgcgcaaagttaacgtactgatacttcttacccaaattttgaccgataccatgaacacagagaacgagatggttagttggtctgtaatgactcttttcacttgaatcaccattgtcataatcctttgacatttcatctttcatcatatcttcttcttgtttactgttattttcttcgtttgggaacttcacaaggtcgctaaattcccaagagatcatatcggatatcttacctaaccccatcgcatgttcgataacttgaccctcgatctctttcgctctttctgttagagaagatggttcctcatagcccttggtaagcttggatgcacccaattgaatcagttgagccactgagctccgtaggatagtaagctgtaaatgtccaccgtagatatctggcaacaaaaaagcggtcctatcgtcttcaaaaaacataacgtatttccatttcgaatcttttggtaatcggaaaatatcacgaagttcagtggttttagatttctctttgtccctagagagccactgctgatgtaattcttcaatagccttggttaagtcatgactcaacggcctattctggtcatcaaaccagatacctcttcgtatttcataggatggtccgtcccaatagattggattcatagaaaacttttccagatcaacctcgaaaagatgatcctcattaacatcaagtttcctactgaaattcttctgggtatagaggtcctcaatccgtttggagtcgaccttggagaacggttgaaattttaaaggtgccgtttttggtacatactctgattcaaaaggtttggttttaggaatgtcaattgcataaaaccacctagatgagaaatagcgcctattttctttccacatagcccgcaccttcatcaagcttccccatatattttcctttataacaagcactttaccacaatcctgtacggattgtaggccagcgtcaaggtactatttcattctagtttatttttcaaaatattatctttttgcatgacaataggggaaaactttttaagttacggatgactgaatagataaaacattcgacctaagtgattgcattaaacattgctggcaacgcaatccgctggagtcaattaaagttctttaatttatatggttacatagtgttttcgttccttaaatattgaatttcgttcagtcatcacgattgaaagacctaagctttgacttagcacgaagattataatgtctagaacgtttttcttcctcaggaatgtgattctcggtgacatgtatgacatctggtcttgctttcttttcggcaggcttattccgttcattgagcatactcctttttctaggtttcggttttgcttcttcttctgaagcggttcctaaaccctcctcatcctcatatttcattatcgtttcaagatcattctttgcgtccttgacgtagttgattatatccttgaaatcgtccttgccatacattttctgaagatgggtcgttgatttcgttagggcggattcttcagctaccgaggttgccttcggcgtgtctttcgtaatttttttgtcattatgttgtaagggtatcggcgaagccaaatagctatcctttggagttttctttaactctttgaacttcgctaggatctctggatcctgcttttcatccggaagtataacctggttactgagcaccgctaagggttgtgactgatagtggagaaaatgttttagcctcatatgattgacaataccttgcgcagatgtgaaaccttcccttccacattgagagcatgtaattattatgagtattccatcaggtcttctgaatataggctgacccaagtcagtggttccgatcataccactgttgctagtagcgcatgtgctactgaagtttcgttggtgattatggtgaggcatcttcgaaattattgcctctgatttctgtacctcagtggctgaagtttgttgaggaacagtctttatgccacgcatacgaatgtcaataacgttttcattagcaagccgtagcccactaactttcgatccgcctttacttcttgtatggtagtaatagattccctcgcgggtttccacatttgagcatcccgccttgatgctttcctccacctctttagttctcgtctcttggtactttgagatcttatccgttagttcagggtcatcatgcattatctttaacacttccaactgcccggataccttatcattctcttctattatatgctccatttctttatgtgtcaacatgatctgcaagtttagttggtccagtatttctcttcttgtggacataaactttaacctttcagcatcttcatgtgggtgtgacgagtgtatagagtcattatcctcattatccgctatagaagagagttcatgtggtgattttggagttgccacttggtaatatgatatcgtgtggtttgatctggaaatgctatctacatcatcttcatccatgaaaagtacctgatgactatttctatgatccacagaatgcattagaatatgtttagcaacaaatatagggtgacggacgtctattaatgtacaaatttgctcagtctttacgcccttttcttccaaaatctttctattgttaataatccgttatgtacaattttttttttttttgttactacttatatggaaaatgagaatgaagagaaaggctctagctgtttaaaaccgtaaacacattggataaattatgcctattttgaaatgggtcgaggaaacagcgcgacaagaaagctggtgtctgtaaaccaatcaacatgaccacttagtgagggacaaatattgagaatcttttgagccgtgatgagctcaggtagagagtccgttgttatcagtatttctttgtatttatccttttttaaagttttccaaaagtcattttagatagatcttccagactttaataaactgggcaatacttaaattgagaacacatgagtgagccacttccccttgactaccggtatgtctgcatatatcttatgacaggaagagtatgagcaaaattattacggatcttgatacaattgccggaaagatcgaggagtacgcaggagatacgttgttaagacttcgaatcttcgcacaatttcaggacatttctcattcacatgaaagaaccgatgggatttatcttcattttagcaacgttccagatttcaatgcagaaacgaatagagaaagatcatattatttcttgattgatgagacaatctatgacgaagcgttcatcaataccaaatcaggtgaaagaccacataagggcgatatcttagatatgagatgttgttataggaagtacgataaagtcgttgaaattatgcatctgaaagtgatatcgatcgcagatttggattcattacgagaattcttggcgaaggcggacgatgactcagagattagatcttttcttcgatgaaagaggagaaatgttacttgtatttctttgttaaaatctattaacgattgtaatgtacataaagagacagcacacatgcatctatatgaatatataaataaagctatgcttctcagagaggtgaagttaaatatatcgatgctccgggtttagaatctgtgataatttgaatcttaatcatgaaggtaaaataaaaagtaagtaaattaagctgagcgaatccctttgaaaaaaggtatttgctatccaagaaagagaggtagaaagaagtctttgatgttttctcttttcatgattattcaaaacgcaatcctcttggagttctttctcttgtttttcaatagaatcttttgtttttgtagttgttcttcagcttcggattcggattcaacttcggattcagcttcagattcgatatccatctcctcgtcactagcctgttcaatggcttcttccttagcagcttgtctagccaactccacttctctcaatctcaataactctgggttagattccaccaaagccttatctctcaagaagtccctttcgttgttacccttcattctgttcttatagaaagctctctcacgtctttgtctaatctcttcgattctactcatggccttcaaagtcgtagctacaagctctctgttgtacctcactggaacgtttcttctctgtgcaaacgttagggtagaatcaacagccaattccttaccggcagcctttctgaacgctttagtccatctcaacttacgtggatttctacgttgcttgaaagccttgtgacatttagaacgacagaaacggaactctttggcatcgtttctaacaaacataataccatggcccggataacaaggcgatgaacagaaatgacatgcgtaaactctcatcttatattattatttctctatcttctcaccaggatagatagtagcaccaaacttgaacaaaatcttccgtaaaccacaagaatgaattcccgttcagtaacttcccagataaccgtatcaaagtgtcaaggtaatggatcgtagcccttcttgattcagaatcaaataatgatacttttgaaagctcatctctgtataagttgaattgtaatttttttttcgaaatatttcattctcaaataacccactgaaactaccgcaccatgaaagaagaaattcacatacaaaagaaaaatctgcgatgagatgagatgagctgaaaagggaatagaagtgagaaaaagaaataaagaaggaaagagcaaaaagatcaaatccgtgaaagatgatttatatgaatttcagatcacgtggttacgaggaaccccacagctacattatcatgtcacacggatactgagattttcggatattgggaagtaggatctttgttgtaagttttccatcgatgtaaaaaatatgacaatagtgattaatgaatgatgatttagtgaatgaattaatgaatgaatgaatcggagaaataaagaaatacatataaggttttaatatctactcaaaatatttattacagaggttcgctccattttaaagcaactctgatctcgttgttatctgttttcttaccgtctgtgatccaagtgttgaaacgaaatggcacaacaaaatattgaagttcctcagctgcccattcctggcgaagataattccaacagggtaccagagcaagtagtaattggacatcctgctgctggcgttcctcctattcctcagcagaaatccggtatggatttatatttcgatcaagcattggattatatgggagatcatccagtgctcaccggtgtaggtgggttctttgcgttgtattttgctgccggagcttataagtctgtgtctaagagacttggaggatcctctcaaggtgtgaaatatttgaaaggtgggtttgatccaaaaatgaacgctaaggaagcactagcgattttaaatttgaatgagaccaatttgagtaagaagaaattgaaggaagttcatagaagaatcatgctggcaaaccatccggacaaaggtggttctccttatctggccactaagattaatgaagcaaaagatttcttggagaagaaagtggtaagaaagtgatttttattgtttctacagtagtgcgccgaaggggatactatcagaaacagtagggattattactactacgttgcattattctcgggctagaaagaaaagcaaaaacaacaacttgtaaataccataaatataatactttcgtgtttttaatttatgttcttcccggcggaagctgaataactcgctggaaatgatcatccaatggcgtatgcgccagcttcctggaaagtcttatcacttcctggacacttatcgctaacatgtttcacatagtgttctaaacatccgacgtgtagtccatagttatgctcttctctggcttctagacagatgatgccttgaagtacaacttcgttacaatggacacataatgggacgtcaaaattctcgactaaataatctttcatttcaatcaagaacctaacgtctaatccaattttcccttcgggagaacgatagagccatttgcgctcagacaactcaaacaagagctcttctgctcttgtttgtgttatttcgtttgtttgcatgagctccccagaaccaatccgatacgagacaaaatgttttagccctgcatagtgttcatcaccgtatttttcacgtaatatattatccacctcatctatcacatcactggattcttcttccctttcaaactgctgtacgtaactgctttcagttagtatcttctcgatactccacttcaaaaaccctatatctgctgctgagaatgatgtcgccattttcatttgggaatcgtacttgagattggtatacacgtaaaatctggcattgggaggccaattagcatccactagatctgttatgaaattttcaaacctccggctcacgtatgacttgcccattggatggtttaccatcgttatcctatagttcaagggacttagttgcaaattaagtttactgacatgatctgttagtttcagcctccaagctgtcaacgataatggttcatctttcagaaaccttccagcgtcattctctagcgttaagtagcatgaaagtagtgagttctcactcactatccctttgcattgtagaataaactgcagtagatatcgccttacatcgagatctgtaagatatggcgatgcctcgacgactctatctgttcccgtttcgtcacttccagtatcagtcattcttttgacggtctaattctaaagatcaaacctataatccctcacaagagatgaatccaatacttcaggtacaggacggttcgtacgatcgctgtttttttgcacagctcttgcttcatgaacaccatgcacaagtctacttgatatttacaatcttagttgatttcaataacaagacaaaataaaacatactgaggtgggagaaacacctatatgcttcattattattcgatgaaccgggtgtatcgcgttaagaagcaaccggttaacaagtggctaagaataagttcctaacctgccaacacatccggggttatctttatattgaattagcctttattgtcacgtgaatgaccctctttttcaggcataattgccgtggcaaaaaccgccgtagatgtcggacagagcaatcttgatcctaaattattgaaagaaatgtcgatatagtgacgatttaacacacatgaaatgagtatttagaaggacaaaacactagccccactataacaaaccgtattttttcaacttcagcaagagtttcattatttgatatatccggtgcgcacttgtgtcataatactaccaatacttacctggctttgctagggaaccagaaatagaaacataacggatcttgctaacaacaattcaaagaaaagccctgttggaataattgcagaaaaacaagctcggaagacgtcacgaacaaggctaataacgcacattgatgcaagaaccgatgaacaggatacggccgtcttcaccgttgagtgggcagcggactgttacctcaggaagtacccggcgaatttggttacaattagacacaccatgcgatagctttcgcggcgagaatcctattgaggatactttatacaatcaaccaactagtgtcgacattgaagtgagagatatgatagatgatgtgaaaagtaaggtattgaacaagttgagtaatacgagatggttcagattcaaagataacacgaatataagtcttgggttttattattacagtgcggaactactagagccatcgcactctcattcagttggaccagagaaagcaaattccaatacattcgtaataacatactctgagtatcaaaatctgataaaaaggaatcagattcgtgttggacgatggtcccaactgcataactcatttaataggttgttacacaggtccacatctcaaagtccttctttggataccgcattcaatgatgacaatggtcttaggatgttatcttctcagcatacacgacagcaatctcaatcccctgatgataacctgaaatatgcgtacaaagtcatcatagaaccggatacgcccgttatgacggtatacagggagttatatgggggtttacagaaaagtgaagatgctttaacagtgttttatcctccgatgtcttcaagttctcctacctctcctgaagtattgactcctgctgaacttttagatccaatacgtatattcaccaaggacgctataggacaggaaaaagagatcctactctcagatattagccagggaactgaaatcgattctgttgttgaaagacccgatcaaagacggccaagtctttttggaagtttctcaagctcgcgtaataacactggaatactactattaccaaaaggtgtatcccctgaggatattgaaggtagcaatgattctccgtatgaggaagcgaatatttccttggataatattgaaacttcaccgccacatccagagagttacgcgttgacagcccagaaaccattaacagaagaggaagtgggtatatcattaacaaagacaatatcgtctccagaattacctcgtccactatccagaaggaccacaccctcattagataagcaaggcaaccttccaaaatataaagtgtttcctcgtatcaacgtgcttattgtagaagataacgctataaaccaagccattctagcattatttttaagaaagaacggaatttcttacaaagttgccaaagacggagtggaagcaatagaaaagtggaaagaaggcgatagtcatcttatccttatggatttgcaattgcccctgctatcagggctcgaagcaacaaaaaaaataagagaactggaacgaattaacaatattgggaatttctctcaaaagagtgtttctaagaagcccaatctgaaaaaaaatgctaattctaaggaagaaggaggtacaactgctgcaaagacaagtgatcagcaaaatgaagtcgagaaatcgaatcagcagaatatggtgttggacaaatcgaagtttaggtcacctgttataatcgttgcacttaccgcatcttactcacaaattgatagaacagaggccctattagctggctgtaatgattatttgaccaaaccagtcaatttggactggttaagcaaaaaaataactgaatggggatgtatgcaagcattaatcgattttgatggctggactgaaggacaaagaaggatgactgatgatgtacttttgagacctcaaattgtaacggcaagaaaatcacaagcaacttctactagatctgtaccgagagtttcttctgtctcaacgacacttgaatgcgatgattctaaatatacaaaatcgaatgactgttgtccgtgaatgaaaccatggaataattgaattactttgagttttctcaagttgtaacaatcatacattagcgttttactataatggtcatcagatgtctttctccggcaagaatatttcaacattcttcccacctattacagtccacaatctaccgatagcatcactaattcaacatcttttaggttttggaaaagtataataattatgaccagaaatcatgctatgtaacattaacaagaaactatattagtattgagcatatatcttagtaaatatgacattattgaggtagcaaactgtttcggacggtactgaagcagccatgtcatattaaccagccttggatttagaacaaattctttgtccgggtaataataacaccaatctctgactttttgtttgatttcaagaacatgtcaaaagtaacaaacactaaattaaagtacggtttataatgaaactatcttatatttccctcaagagacaactgttacataaacaaccatattgcacgaactggattgagctgtgttgatactataaatataaactctaatatcatttcagtcagtacgatattaattatgtcggaaagcaaaatattctacaagtataaggcacatgaaataagaggggagttggtttcggattctggtaaggccagaggtagttcgaagaggaaactatgtcttcgaaagattatagcgaatttgatcatgggaaattatcatgaaatggcacaattattcgttgacgttctacaaatatggaatagtgaaaatgatttagagataaaacgaatgtgtcatcaatatttttgcactttgactccatcaaagcctgatcagttaagaatggctctcccaattatcctacaagaccttctatccaattctgaagagctgtgcattttatcattgcgcacaataacgtcgatagatgaaccggagtatattcaagaaggcttccagcatgtgaagaagctaatcatgacaacttcaaaaatatctattccactaaggaaggcagctatccattctctgatcaaaatggatcaattagatcatacgaaagttttagaactatattattttctcatggatatgttggactacggtaaagaagaacccacaatattggttgccgctgtcacagtacttcatgaaattcatgttagcaatcctgatatgaacccactccaactaacgcagaacatatgcttcaatctcttagaggtattaggaaaaatcaatgaatgggatattgcgattctattcgatatacttactactgcatacttaccaaaaacgcattctgaagctcaccatcttatcgatctttctgtaccgaaattgcataatttgaattcatctgtcgtgctcaatgctctaaaatttattatctatctaacaaattacgttgattacattgaagagaggcttgtgagaaagttctcaagctccttgacttctttattgaataagcctcctgaaattcaatttctggtattgagaaatgtaatcttacttttactatcgcgtgactctccactgatacaccttgaacctaataacttcttcattgaatattctgacccgacttatatcaaagatacaaaattagagattttatatctcttagcgaatgaagaaaacacttctcaaattcttgacgaattaaagggtcaagcaacagatatcgatatccaaatgtccaaaaagtcaatcagagcaattggtaatttggcagttaagtatccacattcagcaagatatagtgttgacgtcttgctcgaacttctagaatttggcgtcgattacattgtgcaggaagtcgtttccatgctcaaaaatgttctaaggaaataccctaatcagtttgacttcgtagttccacttttaccgcaatattctgattccatccaagattctgaatcgaaatgtgcaatgatatggatcgtcaccaaccattcaaatcaattggaagacccaataggtgtattccgcaaatattctgataacttcaatactgaaggtctagaagttcaattattgcttctcaactcggcagtgaaatttttctgcagagcgcaatcaaaagaaactgaacagttgtgtcttaaattattgtcaggagccacagaaattaacgataatcccgatcttagagataatgcatatatgtattggagattattgtcattggcaggaaactcttctgagccactatttaacaacgatgtggtacgggacatgatagatggtgaacttcctgtcattgaaatcaacacaaaattggatccaattgttagagaagagttggagttaaacattggtagcattttatcggtatatttgaagcctgtttcccaagttttccggggtgtaagccctaagaagttgccggaaagtccagcacttaatcatgaaaaatcatccttgtctataattaatgactctatcagtaacaattctactggaagtttccacggttctgatactactcggagatccagttctccaattaagaaaatgacagatttcgatagaccagctgaaacagtaaaccaactgaaagacaaaagaaaatccagcatatctctttcagcgacaaaactagcaagaaagccatcgatgctcgcaagaaaattgtcgatgcggaagcctttccaatgaacaaaattaaaactagccacgcatgtcacgaactttaaactaaacatatatatatatatattcaatcaatatatttaaaacagtaaaatctttacagaagatttattcttcaaaaactccttgagtactttatagagaacagcggaatcatctgatgtgaaaattgtgttattttttggatcaaggtaactcgcatcaatgaatatatctaatttttctttgccttggaagaaaagatcggtgctctctatgattttttgaatacgtgttggagttgatatgaaatattttacagtttctgaggaaaagtttttacccttcatcttcttattggacttcttgtttttcttctctggtttggattcctttttagatccaagcagttcctccaccttagttatatcatctttaagtttattctttgagaacaattttaccgctgtttgatggccgttaacacttctatatacatctgcaacgcggatgttggattgagaaagaattatagatctaggtgactttgaaaatgtgtgaatgaaatcttggaaattattcaaactgcgatccttttcatatttttccgtcgataagaagtcctgtttcttaaagtacaactcatctaattctaaagcacttaaatcagggtttttgtcacggattgatgtggctaagtactcaataattttatcaactgatgccttagggaggttctccttttgagctttttcatacgccatgcgttctagttttttttgatggagagaagaattagccagtttcttttgtcttttacttaaaggtttttcagactcttcagtggataaagtgtttccattatcttccgtatccaatgctcttttattctctgaaacttcatctgcagtattactatcattgtccttatctagttcgactagttcaccatcggataccacatcatcgtcttgggcatcgttaacctcataaactagaccatcatctaaatcatctgcgtgtaccattatgaaacacagataaactggcaaggtactaaactgtgctacttactagaaaagaaatttcttaatgttggcactactcaatcataggaacctctgttgaagccaatatcaaatgatcagttccatgcgatgagcttcaattttacactttttctctaaccttgaagattcacggcttttccaactagatggaaaaagaaaactgttaaaaatgttacccgtatttgcgacaggttcaaaaacatattatatcagttaaaaaagcattagacaattgcttaagcatacatagcacactttcaacaggaaagatgtggcattaagatcaaaacgtatgttagttattagtattattattgttattatttgtttggttcaataaatgtacctgaaattcctgttctcaatatctgtcttatctaagaattgatactgttctggtttagtttcggactcagcttgttctttgtctcttcttctgttctctgtgtaagaagtgtaaccaatgtacagttgcaatggaacacaaacacattgagtaactagcaatgcgatcttggcaggaatgtatcttgggtatgagtaagcacggaacatttgtggtgcaacgatacatgcgatattgtagacaatcatagttaacccgtttcttgctagccttttggtatacccagaagtgttacaagtattccagatataaatgttcgtaatggtacatgaaccactgtataataggtacaacgataataggttaccgattttatttgttaacggtaaacaaatcatgacaatgcaaccaatgattgcaggaatgtacatagatgtcgtgattaaagtgaattgggaaaatcttcctatcaattgggttgtgattagaataatcatgatggtaacgcatccgataggaagttgcaaaagggatgtctggtagctatcaaaaccaaatgtacctgtgatggtcactgaaaaggttccaatggatccagttgaaatttgagaacaaccagtcaataataacattggccatgtcaatttatccttgagtaacaattctttcacttggtgcatcttgattttctttgtttcaagaccagtttggtttgatctgatatgttcaatgacttggactttctccttctcgttaaggaaccatgccttaggaacgttatctggtaaatagaaataggttactataccgaatcccacggtcactaaaccgacaacaaggaacatgatttgccacgaggtaaattcagttccgtggtaatgtaaaaacccaaatgacattaaaccaccaatgatataaccggttcctgcttgagcagcccagtaaccaattctttgcgtttgttccgatttcgtataatacataccgttgactgtaatgcatcctacagcactacacgactcgaacaaccctaatagaacacgtacaatcatcaaacttgcatatgtcttacaaacacaatgacaaacgacaacgacaccccaacatatgatgaacgagcccaacactcgagacacgggaaacctttggagcaaatacaccgcaaacggttctgcaaagatatacgatgcagagaaaatagtacccaaattagaaaactcatcaccaaccaaattgtccttgatccccatcgatgcggcataatttaacaatgccttgtccaaaaacatcaataggtacgtacagcataaaaatggcaaaacaaatatgtcaagctttctcaacaccttcttatctaacacatggttcccaaagaaagttgtcttctctgtaatatcttcctgttcgatgctcttatcgtccttcaactcggccgctgcggaacttagaaggaactttctagctacatcttcctcatcgcttacggaataaacagactcactgagatcttctttatctggcatcttttctggtttgcctatcttgttgacttcgttctattatttttaaattggggacatatcttcaaatttaccagggaggtaattcgattcatacttcgatccgatgaggttcttttatacttctcgatccgtccaaagattcattccgattcctaaaccactaaaggtaactacaagaactgaaagaattgaaaaaaagtcttgccaacagaaacaggcaagtgcaagagaaaaggaccatctggcccatctggcaccttttttccattcatttcacctcatttcatgcaatatgcatgtatgtagctcaatgcaagatgcggttacgttgatctggctaaagcaggtaacgtgactagcaaagggtcctactatcttagataagctgataatgtgattgtgtcagaataaaaatagaactagagaaaaagaaaaggaaaaacgtgcgcgacgaggctcgagagaagcgtcagattaaattgttaacgacagaatgcaggattataaaaaaaacataaagggtttagtggacatactagatctgttgtctcttagcttcttggcatttagtcctttttgaaagagcacattttaagacacacaagaaacggatatctgtgaataacgtagtttctgccaagtaggaacgatgtggaaattgacattgttcttggcgatatgggtaccgataagcttctgttttgtgattttagaggacgagtttttatatcttcataaaaatggtatttgcaataagccacaatttcactatgaagcagataattcagaggaagagttcgcggtgttttacaacaactgggatggattgcagttaccagaaacgagattcggagaccagttcaccagtaaatatagttttttgaaatgggttgacgtattctatggtaccctgggtgggcatatgttctccgggactgctgttccctttggtatgtgtaagatgggtgtagatgtgatcaattcgaaaaagggcgacgcgtactctgggtttcaacccgatggtgaggttgttggagtttcgttattgcatgaatctggtaccggtggtgctcccacttatggggttgtttcgcagcttccaatgatagcttcgagtgcaagttcagttgatgtaacgaggcaaatttctttcaagaggaaatcgcctgacgttgcgcacattggctattataaagtagaactcgataacggtgttgatatagaattttcatctaaggataggtctgggttgtatgaatatactttccccgaactgaaagacaacgggaaaccaattatcatggtgaacgtgtctcagcatttgcattcttttggccgtccgtggtggactcagaattttagatcgggccaaatcaaagtctcttcagatttgaagtcttatcaaggtaaagtgacgataaatggaggttggactgatcccggtgaatggaccgttagcttctttgggaagtttgacaagcctgcacgtaaagttgctacgttcaggaatgggaggactctaccgttcctcagaagaatgcaatcttactctggtgaatctgatattggtgtattatttgaatttgatgaggatactaccgtgttgaaatcgcatgttggaatcagcttcaacaagaacgaaggtgtcaaagttgctgcgcagaatttgttagacgattatcccgaagactcacagtttgatttgacatggtctgtagcgtctgctctagaatcttggaatgataaattgttcaagaagttcgagatgaacgttaatgaagaggaccctttgatcataagtaaactatacaattcattgtatggtactcatttgatgccaaccaataaatcaggtgcagaagcaccgtgggataatggtgagccatattacgatgattggttcacactttgggatacgttcagatgtcttcaccccttgattaatatcatatcacaagaccatggtgcagaaatggtacgttctttaattgatatctgggaggttgaaggtttcatgccggatggcagatctggtgacagatctggaagaacacaagggggtagcaactcagatatcatgttggcggatgctttcattaagaacgttcatcaagggatcgattgggagaagggcttccaagctatgtataccaatgcagaagtggagccgccttacattgaggaccctatggctaacgactcgacaaacaaatttgggagaggcgctttaaaagaatggcttgaattggggtacataacaagaaattactcaagaagtgtcaccagaactatggagtattcgtataacgattttgccctttatatcgttgccaaaggtctcggtaaaaaagatttagcaaagacataccttgaaagatcgaaaaactggcgtaacatttggaacccaaatgctaaaagtgtgaatatacactatgactacaccggattcgtacaacctaggaattctgacggtacgtttgctcaacatagatatgatccgtttacatgctttggttgctattggagagacgatgaatatgaaggaaaacccgtggaatatgggtggacggtgccttttgatatgaagactttattagaatacattggttcgaaagcaatgtttgaaaaacgtttagatgatatgtatgcgttctgtggccatgagaacgtggttgatattggcaatgaaccaagttttttgacaccttatctttacgcgtacattaacagacaagataaaacgtcagcattagtggattggatcataaatacaaagtttaagacgggaccgcgtggtttgccagggaattctgatgcaggagccatgcaagcgtggctaacctttgcccttctaggtttttatcccgtggctggtactgatatttatttattaacaagtccgaaagttaattatttgaaacttaaaagcatgcctaacgttccagatattgaaatttttgcacataacttatattcagaatttggtgtcagaaacaacttcattgagaaagttgttatcaatgacaaagaactcgataagaactggtttagacattccgagctattcgaacacggtggtaccatcgaatactacatgagtgaaaaaccattggactgggattcagataaagagtgtccaccacaagaattcagcgtttaagattcaagtataatggtgtagttcgttaaataaaatcagtgattattaggttttacatacaaccctcgctattttgtgttgaaactttttgatcatatgatcacatgatcaaaatcatgtaagaaaatttagtgaatttataacaagtgaagcaagatttgaaggttaaagagtaacgctacaccaatttggctgaatagacgtagagctccaggcattagtcgattttttaattggactacatttggctgtactctggtcaaattttattaatcgtttttgattacgataatgcctcctattatagatagtgaatcagacgatgaacggatcattggaatcactaacaagagacatagacaagatggtcagaccaaagtgctgaaaaacaaagtgaagaagcatgttagaacaaaagaaactgcagattcggatggtgcaggcaatgggaattctagtgatgatgaagaggatgaacgagttcattcacaactatcaaagagaagtcgtgatccaagaaaaatgaagaagaaaaagaagaagaagctgtccaacaagaacttacaaggtgtcaatggtggttatgcctgggaagatgacattcaaagaagttgggaccttgtcaaagttgatgatgaaggcaatatcgctgctattgtggcaagcatagttgaagcaagaaaaaaaagggcagcagagaagacggttactccgtatcaaagaggtattatcagaacccttatcttggtattggattgtagcgaagcaatgatggaaaaagatttgcgacctaatagatatgcaatgacagtacaatatgctgtagactttattcatgagtattttgatcaaaatcctatttctcaaattggtgtagttgttatgcgtgatggtttagctcagctaatatcgcaggtcagtggtaaccctcaagaacatatcgatgctttaaagatgcttcgtaggcaagaaccaaaggggaacgcttctttacaaaatgctttagagatggctagaggtctcttacttcatgttccagcgcattgtactagagaagtactcatcgttttcggtgcattatcaactacagatccaggtgatattcatcaaacgattggctcattggtacatgagaatattagagcaaaagttattggtctatctgctcaagtctccgtttgcaaagagttgtgtaagcagacgaattatggagataactcatattatgggattatattgaacgatcatcattttaaggaactattcacaagtgcagtgacaccgttaccggtgagcaaagtgaacaaagggttcaccttggttaagatgggattccctaccagagtatttgaggacacaccatcattttgtgcttgccattcgactctagtccatggtggttacgtctgtcccaattgcaaaactaaggtttgctctctaccgacagtatgtccgagttgtgatttgatgttgatactctcaacacatttagcaagatcgtatcatcatttgatgcctcttaagactttccaagaagtcccagtgtcagatagcttccctacagactattgcttcggctgccaaaagcgattccccaccttaagaaataacaaaacaggcgaactattaacaagcagcaggtacagatgtgaagagtgtgatcaagatttttgtatagattgtgatgtattcattcatgaaacgttacacaactgccctgggtgtgagtccaaaccaatcaatgtaaatatcaaatgaatttaacccgctaatcattttctcggtagttccaagaagaaaatatcacaagaacgacttttaaacattgactcaaattgtatataacattgaatggttactaaaaaaaaggcactcacatcctttacatctatttacaatgtactccccctgggttggctggataccgctttccctacaattgtataaatctcatctcctaatcattatctgcttgtttagtgcatctcagattgtgacaaaataaaaagtaacgattattttcaaaatttttcagctcatcggagaaattgcaaaatgaaacctcgaatagaaaaggcaacaagataccaaccgatttttcaacgacctcacaaaaaaaaaatactgtactgaataaacttcctgttaccatcaagtttgtgctatatctctaggacaggtaggttctttcaaacttgagattcacagggagttcaaccgtacgtctctttacatttgcattggcttcttactgttgatttttccaatcactttagtctgctgtcaatccggtttaactgatttcactaattaaatcggactcatcctcttcacaattaaacatttctgttaagtggttgaatatacagcagagattgttgcattattttatttattttgatatttgacatccttcctgaaagagttcataccaactcgaaattatcacaatcacaattacattgatactatacaactttggatatccattgctgtgacatttccactatcatcatttttttttggaccaatattgaggcacaggtttaatggataagtacacgaacagacaccatcctgatttcattcctggtactttcaatatctatcattctaaattattggaaaatggattaatccatggttcaagattgaaaaaggatagtaatggtgttattttaattccacaaccttcggactctcccaatgatcctttgaactggtcagtcattaggaaattggcacattttgccttgatggcatttatcactgccttcactgccgctactagtaatgacgcgggtgcagcacaagattctttgaacgaaatttatggaatcagttacgatgccatgaacactggtgcaggtgtcttatttttaggtattggatgggccaccttgttcttggctccctttgctaatttgtacggaagaaagattacctatctaatctgtatcacattgggtttattaggcgcattatggtttgcgttagcaagcagtaccaaggataccatttggtcgcaattatttgtcgggattagtgagtcctgtgctgaagctcaagttcagttgtccttgactgatatttatttccaacatcaacttggatctgtgcttaccgtctacattttagcaacatctatcggtaccttcttgggacctttaattgctggttacattgcttctttgactagcttccgctgggtaggctggtgtgcagtcatcatatctgggggtttattggtatggattgtctttggctgtgaagaaacctatttcgacagaaaacaatatcgtactccgttgacctcgcagaagggatatagtggtgttgaagatggttctagttaccaaaactcttcaaaccttttggagaagaagaccatgttgattgaacaatttgcagatagtaagaataacgactctaagatgaacgaggactcgaatgaagtcaccaacagatatgccgattatccagaggcttatgaaaacgttgaagaattgatcgatggttcgaaagaaaaaatgaaaccgtattacaaaagaattcaacttatcaccaagtctggtaaccttagagggtatggtttcaagcaatacttcaaatatattggtttcaacttgagaatgtttttattcccacctgtctggctatctggtatgttttggggtattcaagatgtttttctttccttctatttgactaccgaggataccgtgttctatgaagcgccttggaactactcggactatggggttgcaattatgaatgtacccacgttgatcggggcggtcatcggatgtttctacgctggtgttattagcgattattttgttttatggatggcacgtaaaaataatggtatccttgaagccgaatacagattatattttgctgctgccactgctatcatctgtccagcgggtttattgatgtttggtattggtacagatagaaacctaccatggcaagttatttatgttggtttgggctttatcggttttggatggggttgctcaggtgatattgccatgtcttatctaatggactgctatccggagatggtgctagaaggtatggtttgtaccgctatcatcaacaacacaatatcttgcattttcacgtttgtttgttcttactggctagacgcatcggggactgaaaatacttacatcgctcttgccgttataaatttcgcagtcacacttttggcccttcctatgtatatctacggaaagagaattcgaatgtggaccaaaaagtggtacaatgcttccattgatcttagagatggtatttaagatcaggcagcctcgtctttctgtcctgttggctgttatagcctacttcacgccatatccgttttacatattttcgtaattttgtctctttcttctaaataatagatcaatgatattgaacgatcataaggcccaatgatatttattttggttatccattcaggcaatgaaggatttgccgtactttcttttcacaattaaagcttagaaagttttggtttatttacaagtttttactcaagatactgatttcaatgtcagaatttcattgatattgtttaacttttaaagttagtagaaaatttatacactaattcctcatattaaatatggcgaattgtggtgctttttacttaactgaatagaaaagatacgagacacttttgctagtttgcttgaaatatgttctaatgatttgttattgttattaatgtcgtgtgccataggtcaattaataatatgccagcaatgttgaaacggttcataaactatgatcgggtaactatcaatgtaataggcggttaagtatcaagatgatacataaggataaacactatggattcatcagataccaaagatcttgaaataacaacacatgactggaaataccagtatcaccaacaagcaacaactaagatagtacctctgcaatcctttgtaagaaacaaagagccttgctggcgcaatcggtagcgcgtgtgactcttaatcacaaggttgggggttcgagccccccgcagggctttgttttttacgatcttcaccaattaatatatactattgttattttagtttcaatttcaaagttcagatgaaaataacaatgcatcacatcgaacatggtatccaatcaatcgagtgatgtattaacaaatataactgacattgttctaattttctcagtctactttttccaatctagaatgcggtaaaagagtattattttgggactgccatcatctttcatttgtgcctcatgagaagcgatattctagattgtttccattgcaggttatatcttaatggttgaagaaattcttatgtaccgctcgctactcatcattcgaatgaataaaacacacaacggtgatttgaattcagaatcaaacaattcctccaagttacacaatgagacacttatttgactggtcgggattccaattttcgcccgttgattcagcaattgattatcccttaaaacaactgtctgcaagcaaaccaacacaatactagaacctagcacttgcatcaaatgttcccattgatcccatatcgggcgtttttgaactgaatttcgatacttgacgtctttcctatttagtcaatgaaaggtctattaaaattaaaacttcatctacattataagccgtaaagggaaactgcgctataggacaaacataatatctctaaatgagagtccatcattcaaaaggtagggacgtcttgttaattaagtttaatagagggactacggcaatattgtgggccaggtattcttcgcattgctacattcttcgaaacgaaatatgtctggttgattgatgtttggttcgatagccagcgaagatctatagaaggtagaatagggtctaaccttgttttatgaaacgacattgaaatcttatattggctaaaaaatacatcacgtctgtctgttaatgaggtttttcatgcactggttctcaggagtttgaatacttgtatagtaatcttgcatgcaattcgttaatccccaacacatgggtaacgtgttcaatgcgtattttaggtttgaacttgaaactatgacacaacttaactatatgtcattgcctatcagaaatcaagatggaattcgtataaattgctggtagaattcggaactaacttgacacatctgaattaaggacctttacacatcttaaattgttggttgtgtaaaccatcaaactgagcattccgaaaaaacacaacaggcgtagctagtaaaatctgaacctcaacgctccttttgttcaaactttacaccatgtttacattcgcttacatcccaattatcgttttttcagcacttatttcgacttccctcgggaaggaacttaccacggtgaagctttcgaacccttcagtagttgctgcttcaggttccaactcctttcctcaccaaggttggattgcttcacttgactgggcctttgaagacacttcaaatgcaaagacaggggattatttcactatcacaatgccccatgtctacaaggttaagtttaacgagggggacacctcatttaaggtaaacttggatgataacaccgaagtttttgaatgctatgctccccagcaagctgcatataaatacgaggacacaatactcaaatgctatgctgtaactgatatttctgcttatgaatctatatcgggttctcttaccgcgacgttggttctctctaacggcggttctgcatatccaccagagctttctaatgcgaactatttttcatctggagagaatacattgtattttaacgatattgaagcatcttttcaagccaatgccaaatctgaaaccaatgacttctatttttcgggtcgttctactgcttatcaatccctggaatcgtacttcttaggttttaattgcccaaatggttatattactggtgcatcccagcagataatttatgatgttagtaatgagggatacggcatcgactgctcagcaattcaggtttatcaatcgaaaaattttaatgattggatatttcccatcgactatgagacattggatggttccgtttcatgtggagagaactctgtagaaataactgtcgaagaacttaaaccggattatcgtatttgggtaaatgcgttgcaaaatcttgatagtgaggttgcaacagtaagaaattcaatcttttttgattatacttgcaccaacaccgttgaaaattcaacatacaggactactacccattacgaaccagtttacgtaataactgaagccatctactctggagttgctttcacgactgtagatgctgagggacaagagacgactctaacatctaccatcagctgttcgagatgcgaggaaacgtcttcaactgaatccaccagtgaggtatcgtcagaatctactacagaatctactacagaatctactaccgagatcaccactgaaccttcttctgaatctagttccgaaattacaactgaaccaacttccgaagttactaccgaccgtacgactctaacgtccactgtcaattgttctgaatgcgaggaaacctctactactgagacgcccagtgtggtgacatcagagtcaacaatagagtcaacaacacactcgataacagactctacggtagaaagcactactgataccacacccgagagctccaccgaggtatcctttgaatcaacaccggtgagtaccaatgagctcacaacagagacttcttttgaatatactacagaaagtacaatcgaatcatcttctgaatctaccagtgacttcacaaccgaaagctccaccgaactcagttctgaatccagtacggaatcttcgacggaatcctcttccgtgccaagcacagtaccaactacatcaccttatactgagtcaagctctgaatctacgacggagtctgacatttccactgaaataacttcagagcaaccttcagaaacgtcatctgagaccttttcagaattctcatcaaccactgatgttgaaagttcaccgggaacaaccacaaccgccacaagtacggaaatttcatcttcggtcagcaccgtatgcaccgaatgctcggaggatacaacttcacttgatatttcgacagaaacctttgactcaagtacagaaggtagcacaactttggaaacgtcatctacagagactacgcttgagaccagattatttagttctgatgttgaaacatcagaactggtagtggaaacggacagttcagagatcacaattgaaactgagacgttggtttccgattcaacaacagcagttaacacaactgagagctctagtgtacctcctacgcactccaccgacacatcaattaccacagatactatcgaagaaacagaagggacatctgctgaagtattaacttccgcaccaattttctcgggaaccattgaaccaaaagggtccacggacactccgcaaggaacagcatcgatcacttcaaacactttccctgccataagaactttttcaattccatctaacttccaaaaaccaccgccatcttcatccacaacatctctattgacattccaagggcacggaaatcacgttggaagatcaacactcgctggcttgttgcccattttaatttcatatattttcctctagactatgtgtcatagttatcctgtcagttcttatctaatctaccccagttcagttctattgtatactggataatctcatcaactagttctttcctatgtaccacgcctaaacaaactcttacaatttggaatatttctctgcattgccttatatacacattacttgattcgtctttcggagaagaggagtagacttaccttcatcttgacgagaacaataatagtagagtaactgtacaacaaactaaaagcttttcttgaatattccttatactattatttatagctaagattttgcacctgaagttcttagaacaaattcaaaggctgctagggcagccgcatttgcagggaaacttcttaggaaacttggcacaaaacctttgaagaatccattgataccctttgattgataaatgtctttgacggcagttctccacgatttgaaagaaccgtcgtacttgtcattgcataaaacaacttgcttgacaacatcacttgggtaggcagtggtccagaaaccgaacgaggcactaaaaccaccggcccagaaattaatagcagcttcactcatttttgtattctctctgaaccaccttgttagtaattcgtatgatccccaccagtaaacgaaatgtgttctaaagatcaatgttgaaattagacctttatagagccctctgataccttgagcagaataaatctttttgatcacatccaatggtcctttgtatctggtagtagttttatcatattgaacttgtaattttgcctttgccaattcaattggtggtgctataaatgaaacagaccagcctgctaacacaccacttataatacacccactcaagggaagtttctcgtcatttggataaacatatttatgcattaacattctgtagttatgcaagcatcctaacataacagaatccattaagatccagcctaccaatggtggtgtaaatccaagatagaaccctcttataccttggtttctgaacgtcttgtacacacaatctaaaggtcctttgaatctagtttcattttgtgaagtttgtaaccgcaccttaatggtatcgaatggatgcccaactgcattcttagcaacaccactgaacacaccagcaacgaaacccataattctagagtaagtttcattcgagatcaacgaattgactggctctgtaattgcgttggaagatttcgacattttgcacgttgacactaagagttgatacttaacgaatggtagtattacacacttgcctcaacccaacaccaagatgaaatcgtaaatttgagtggttgttggacctgattttcgaaacgtattcaattataaactacaactatgtcttgcaagctcgagaagtcgctgagtcttgattttgatgctgcaactttccggcgatgactgagtataatttttcaccgattcaggcgaacagagagatacgttaggtagagatatagaagcgagttctacctagcccattcttcggggaatgattacaacttcaagctgaggtaccagccctgtcattggtatgagtcgcttctaacatatataccattcatgtgttggtgtcatcacgtgactggagtcataaaagatgccactgtcggtggtcacatagattgtatgtagcactacccatcctttaactctagtcaacagcagcatctatttacatctgttctctgggtggtgtttgaacagtatacgtagcgttaaccctcttttcttatattaatcagatgagatatcaattgagaagcgactttaaacatggaaaatgccgacttaacctggtctgaatcagactaatgctgcaacacatcagccgataccaatggctagacaaacacgacccgctgtaacacgagaactatgcgaacagtgcattggaaacacaaagaatgctcaacgtatggttcttttgatggctcaaatggcagccgcatatgagaaattaggcaatttacgccatagcgatgaggacaagaaacaatcagaaatcataatttctaacctagagtcacatgtaattgtaacgactctcaccttaagaaaactttcacaacgatcggaacaagaggatttgcagctactcgttttgtacaactctacaaagaacgcatggacaaggacccaatactacgaaatttaccagctaaagcagtttctagaagaggcaatcatttccaaccaagattacgatattcttccgcaagctgaaaatgtattgaatggattcttatttaatgaagactatgtaaaaaacctaccagcgttgaacgaagatgtcaagctctcgcaatgggagatattcgcaagagaagttacgcaaataaacaagacatacaggatccaattggatcactttgggaattcagtacaaagagtaatgaaccgtgccaaactgaacaccaactatccacatatcgaggctctcaatatcatgctaaatgaccttaattcttactgatcgactactgtatatgtacgggaaatagccaaaatgtataatatacaatattcaacatgtaagaaaaaacagaaaatgaaagtgagactcagtagtaaagcactaataattaccgaactatagaccccacagacccggcaaacacacgcagctcatcacacaacatggaggtactacaagatttaggacgccagctcgttttcccaattgactttgagtctcaaagttacacagaatcaatatctaacaaggcactctatttgatcactttcttcagcttcatctcaggatatttaacagaatcgatcaaagtctcaggaatagtatttgttttggggctaatagtggtactagtaattgtgttaccaccgtactctgcctacaacaaacatagacctcaatgggcaaactcaggacccactgtagtcgaacctaaatagagatttcgatcagatttaccttaattatcacttttctgattttatatctatatagtaatgagacaaacccatatacaacacactttcaagtacagattagcatccccatcctggtgtaaatgcaggtgcattcagttgaatctctgcctggcgtgcggttgactaaagaatgtacacttctctcagagtatctacgatttctcttgtatgtcgttcatttttcttcataaacccagaatagtttcaatagattttgaacgagctttgataaaagtaaactagaatagaagaaagcttcaatttacacactacctcatttcattctgttaataggtacaagtcattttaattgaatcttggatttttggagttcttgaaatgaaccaaattatagattagaattggaaatgagtgaatcaggttattatttagggttcgacctttctacgcaacagttgaagtgtcttgcaattgacgaccagttaaacattgtaactactgcagctatagagtttgataaagattttccacattacaataccagaaagggtgtttacattaaggatgagggggtcattgatgcgccagttgctatgtggcttgaagctatcgatctttgtttcgagagattgggcaaatgtattgatttgaaaaaagttaaatctatgtccgggtcctgccagcaacacggcaccgtgttttggaattgtgatcatttaccgaaggatttacaacccagttccaatttggtaaaacagttggctagttgtttcagtcgtgatgttgcccctaattggcaagaccacagtacaagaaagcaatgcgatgaattgacagataaagttggaggaccacaggaattagccagaataactggatccagctctcattacagattttctggttcacaaattgctaaggttcatgagacggagccggaagtgtacgccaatactaaaaagatttctttggtatcttcgtttttagcttcggtgcttgtaggtgacatcgtcccactagaagaagctgatgcgtgtggtatgaatttatatggtatagaaaagcacgaattcaacgaggacttactctcggtagttgatgaagacatcgcctcaatcaaaaggaaattgttcgatccaccgacatctagcgacgaaccaaagagtttgggaccagtgtcgacttatttccaggagaaatacggcgtaaatccggattgtcagatctaccctttcactggtgacaatttggctaccatctgttcgttaccactacaaaaaaacgatgtattaatatcgctgggtacctcaactacgatcctcttgataacggatcagtaccattcgtcaccaaattaccatttgttcatccatccaacggtgccaaatcattacatgggtatgatctgttattgtaacggatctctggcaagagaaaagataagagacgatatcaatggagaatcacaaacacatgattggactaaatttaacgaggcattgctggataactcattatctaacgataatgaaattggattatatttcccattaggcgaaattgttccaaacatggatgctgtcactaaaagatgttatttcaagtacatagacaataaagtcgtattgacaaatgtcaatatgttccctgataagagacttgatgcaaagaacattgtagaatcacaagcgctaagttgcagagtgagaatttccccgttgttatccgaagaggccaatgcgatcaacgaaacacaagtgctaaaatcagaattaaaggtgaagttcgactatgatttcttccccttagcgtcttacgccaagagacctaatagagcctttttcgtcggtggtgcatcaaagaacgaagccatcatcaaaacgatggctaatgtcattggagccaagaatggtaactacagactagaaactgcaaattcgtgtgctctaggcggttgctacaaggcgctatggtccttgctcaaggagcaaaaccccgaaaccccatcgttcgaccgatggttgaacgcattctttaactgggaaagagattgtgagtttgtttgtaactcggacgctgccaaatgggaaaactacaacaacaagattcgaactctaagtgagattgaaagagaagcgtcatcacactaaatcaaaaacgctgttagatgaacctccaattgaccgtgacgcatcaatagccatgatgcaagtaagtaagtaagtaagtaagtaggcaatcaatctttgtacacatgatgaacctctcaaagacattacccggaaatcgttatccactgtttgtgaaaaaaaaaaaaagtgttatcccactagagacgacacagtcccccacccgacggttttataccgttgagatgagactatgggaaaggtttagaaataaagtatatatgtgaaagattgaattgtccaagtacacagagctttgaacaaagttcaattgaatacttttgttgtcaattgtttctgggagaaagacgattttatcgacaatctattggtagaaaaaacgaagtctgtaaattggaaacctatattcgtcattcagcgaaagaaggtggtaattaaaagtatcatttacaatagataaggacgacacagatcagaaaagaagcaaaaccatcctttgttaggcctgtacggaagatataggagagagactgtagtgtgtttgttgaaaaaacctgtattcaataatgttccgtttagcaattaaaaacagggcgtgtctccgtcaattacaccaatgtagaactatgttgaaggcccaagcctttgggatgcctgccatgtcaccaaccatggaaaggggcggtgtcgttgattggaagttcaaagctggtgatactttctctgccggtgatgtgctcttggaggttgaaaccgacaaggcaaccattgacgtggaggcacaagatgacggtaagcttgccaaaattttgaaggagaacggtgccaaggatattcctgtcggggaacccattgcatacatcgctgatgtggacgatgatttggccactttggagttcccaaagcccgttgaagccaagaaagaatcaaagccagttgaaactaaaaaggaggaggccaaaccagtggaaaaaactgacaagaagaagcaaaccagtgcttcaaaaacaccttctaagaacggcagtgttcaggctaatgcatctcaaacattattcccatctgtgctatcactactagaggaaaacaatatttcaactgcagatgcgttggacaaaatcaaggccactggtccaaacggtagaatcttaaaaggtgatgtgctagcctatttgggtaagatttcccaagattcgttgaacaaggtaaccgagtacatcaaatcccatgagaaattggatctaaccaacatcgaattaagacctgctagagaaactgcagcagcagcagcagcagcacaagctgctaaacccgctaaaccattacctctagtactaagcgaacagatcacactccatgtcccagaaaacgtcacttactcccaactatctgctgcgatagcatcgtacgtcaaggaatgttcattcttggcacacgacgaaccattgaccaatgacgcatccgaactatacgacccattattcgaagagttactagtacaagaaccaacaaaacctcgtttcaaggtcacttataacatagtagacttggaacctacaccaagacaccgtacctcttcaccacaaccagatatctttgatttattatctggtacaacaacgcaagaactacaacaagaggcatccgcagtatccaaacaacaacaaacacgtcacgaatacgcgttgaacgtttccgtcgccgttgacgaatcgttaacggatgccaagcaaagagcagaaaatttcgttgcccaactatctaacttggaattgttccaatgagtaaaattacgacaagacataaagaggaaaaaaaaactagaagaagccgaagccaaatcttcttcgaaatattcatgccccgtccgcaagctgtatagactggacttaagagccggcagatatatatctatattatcagtataatagacaaaaaaacgacaactcaagaattcaaccaaacaggcacttcagacttctttatggtcttggcacagtaaagaagatcaaaaagtaacatcaaaaattactgcatcatattttcgcagaataccaacctggcaccagtgccctattcagactaagcagctttccattccaaaaataccagtagcctaactaagcgagatgcaagcgaaatgcgagatgaaatgaaacccaaataaaaaaaaaaagacacaaacaaacaggaacaaaattgcgcgtttttccccacagaacagcacgtaatgtgtaccgttttttgtttttcgtttcaagtacaaaaaaaacaaaaaacggtacgctgttcacgtgtctgaaaaaccaggaaccgtaaaaggatattccgttagccaacaaaaaaataggtaaaaagggaaaaaaaaatccaaggcactgtattctgtatatgttaactctgcaaatccaaattcaatctaaattgggaaaaacgtgcctgtatttttgtcctggtgatgcccgttttaatatcgcacgttgtcaagatatacgctgtgagattttcttttccttcactattatatatcaggaaaatacgaaaaaaatcacaggtatgttcctatcgcagtttaaggggattcatttctcaaatggtttcgtgagcatttaaatactgggttatgttttctcatgtatggagctattctattattctagttatgaggctatgattttgtgcaactttttttttttttagatcttcttattatgtgatttattaacatacatatatatttatatataattagcatcagcaatttttttcggactgtcagaaggaaatctttaactgaagccttaggaggtaacccagcgtgccattaccgtatttgccgccgtttgaaatactcaatattcatgatggttgtaaggcgttttttatcagcttcgcgatataatatgccatcttttaggtccaggcccgttctcttagctatctttggtgtctgtgctaccgtgatatggtacctattctttttccagtctaatctgaagatggcagatttgaaaaaggtagcaacttcaaggtatctttcacaagaaccgtcgttatcagaacttatgtcaaatgtgaagatcaagcctattgaagaaaccccggtttcgccattggagttgattccagatatcgaaatatcgactagaaagaaatacgatgcgtcgtgggatctgttgttccgtggtagaaaatataaatcgttcaacgattatgatcttcatacgaaatgtgagttttatttccagaatttatacaatttgaacgaggattggaccaataatattcggacgttcactttcgatattaacgatgtagacacgtctacgaaaattgacgctcttaaagattccgatggggttcaattggtggacgagaaggctatacgtttatacaagagaacgcataacgttgccttggctacggaaaggttacgtctttatgataaatgttttgtcaatagtccaggttcaaacccattgaaaatggatcaccttttcagatcgaacaagaagagtaagactacggctttggatgacgaagtcactgggaaccgtgatacttttaccaagacgaagaaaacttcgttcttaagcgatatggacacgagtagtttccagaagtacgatcaatgggatttcgaacatagaatgttccccatgatcccatatttcgaggaacacaatttcaccaacgtgatgcctattttcaccggctcaaacggtggggaacctttacctcaagggaaattcccggtattagatccaaaatccggtgaattgttacgtgtagagactttcagatatgataaatcgaaatcgctttggaagaactggaatgatatgtcctctgcttctggtaaacgtggtattatcttggctgctggcgacggccaagtggaccaatgcatccgtcttattgctacgttgagagctcaaggaaacgctctacctattcaaattatccacaacaaccaattgaatgagaaatctgtgaaactgttatcggaggccgctaaatctaccgaattctcatccggtagagctcaatctctttggttagtgaatgtgggccccacgttggaatcttcaatgaagagcaattttgggagatttaagaataagtggttgtcagttattttcaacacttttgaagaatttatattcatagatacagatgccatctcctacattaatatggctgattatttcaacttcaaggagtacaaatctactggaacactcttctttaaggataggtctttggcaattggaactgaacagaaatgtggtcctttgttcgaaactcttgaaccaagaattcttgaaatgtactatttcaatactttacctatgatcaatggtgattacgtggaacagcaatgtatgggcatgctcaccccagaggaaaaagtttacaaacgtttctttgaagttggtcatcaacacaacttggaaagtggattattggccatcaacaaaaacgaacacatcatgggattggttactgcaacagtcttaaatatcgcaccaaaggtcggaggttgcggttggggtgacaaagagtttttctggcttggtttgttggttgctggccaacgctactcgatctatgatatagatgcaagtgcaattggtgttcctcaacagaagcaatctatcgctaacggagacgaatttgatgaatataggatttgttctttacaagtggcacatacttcatacgacggacatttactatggataaatggtggctctcagtactgtaagaaaccagagacttttgaaggtgattggaccaacattaaggagcttcgtgaatcgtattctgatgataaagaaaaggctctgaaggcttatagtgatacagttaaggtggaagcagcaatcgtgccagattccagaagtaatggttggggtagagacgatcaaagatgtaaaggctacttctggtgcggcaaatttacttcaaagctgaaaccgtatacttataacacggtggtaactaaaggtgatttgatccgtttcggagacgaggaaatcgaaagtatctccaagattaataagatctggaatgatgctattattccagacggagcttaatttcacggtttaaggatatagtcgcaagaaacgttttaaatttccctttttttttctgttcgtttatatttccgtcgccctatctttccacaatcgagcttgataacacacctccctcgaacactgcataaagtctgctcgtacaactcaaatcgcaatacccccgagcatacggttacatcaggtcattcttttggtctacatgtagccattatttttatgagctgtcgtaagtatttactgcgaactagtatctcaacattcaaatgttagctttgatctttagaaagcatttttgtaatattaaaacatacatgtatagtaccaagaggtattattaatctgaatcactacacaataccatgggtagcactcagcatattttcaatattacatggcttttacctagtagcctgaatcttcaaatcgatgtgtttcttgatattttggttgggtaattttgttctgtacattaaaacatatatagatatatgattgaattaaagttcgtcattttacagagatcagaattggaaaaagccttggtcttccaagaacaagaccactctttgtacaatgtgtaagatgttcttgtcttcagtttccagtggaatatcggatcccgattcttcacctatcttgaacacgttagtgcccttcaaagaggaagcattttgtaagattagaccggttccacttctaacgaaatcagggacaagagctagaatttcttcattgttgccatgttccaaaaccttgtagtgtctaccaccaccatattgtaagaaagtagacaataaagcagtctttagttgagccggtaaagtttctgacaagacaagagcgaaaccttgtttaggtcttgaagggtttgattccctcaaaatcttgacgacttctggataagagaaccatgctggaatttcaccaccatctctcaatctgtttctcaattcagttccactgatattcaaagttcttgtcttgtcagtatcaatttcatcaattggagcatatctgtcttcatctggtaggtatgtaaccattctgaatggaacaacttcgatatccaattcgtttttgtaggattcgactaattcttgagcgtcgtatggaccatagaagtcaacacccttggagttcttaccaggaccggcatggtctctaccaacgatgaaatgtgaagcaccataattctttctaataattgcatgccaaacagcttctctgtcaccacccattctcatagcaagtggcaacagggacaattgagccatgccgttagggtatcttttgatgatttcttggtagaccctaactcttgtatggtggtcaatgtcacctggtttcgttagacccaccactgggtgaattaggatcttagagttgtttgatctagcagcacgcacagtcaattctctgtgtgctctatgcattgggtttcttgtttggaaagccacgacacgatcccattgcttggattcgaattcaagtctcaattgagctggggtctttctccaacctggataatcataatgaacaggcaattgaatagcctctaaagaaccaccgacataaaattcgccagcttgttcgaataaatatttcacggctggatgttctggatcacctctgaacaccttcttggcttcaacggctttatcaggttgataaacatcactgaccgttaagattgccaatgggaactcattgtcctggagcaagacaatacgttggtctggactcaattgagaagcaaattcagcatccacgtccaatgtgattggaatggtccaaactaaaccgttttgaagacgagatttttcaacgacagattgataatcttgttggttaaggaacccatccaaaggagaaaacccaccattcaagatcaattccaaatcgcaaatttgtctggcagtcaaagaccaagaggtcaaatcaccgctttgagcaatttctaacaattcggctttttttgaagcatctcttgcaactaaatcttgcaaaacaccaccatgaggagaaggcatggtatgaattctaattgattataattcttcagttattcacttccaactttgccaagagaatgcagctatccaaccattaataaatgggcagatggtcaattgacatgactgtttcatcacacatgttcatatttatatataaatatttacatgctcagtggaaagtaacctgtggagttgacttgcaatgaattagtcgaaggtctgaagatgtgtgtgttgtgtaaaattgcattgacgtctaaaaaaagccataccggaagaccgatcagtaatgatgctactaatctatccgcttggctgcgcctgatgtcatggttgtttctatatatcatgaggtattacattgaacgctggcacagaaactgcaagggtcagtgctgatgtggatgctgcgtgtgtggaaaaacacaatatcacgtgatatatcacgtgatattgaattattgtggttttgtaagacttttgctctggtttccgttgacctttagtggtcacgtggtggttattgaaagacagagataataatttgacgttagaagaggcgaggctgtcactagtgaaccctggataaagggtatacgagattgtagggaacttacagcgagttttagagcatggttaaggccaggcgttactgggttgattagatagctagatcaagaagttatacaaattgaaatgccttagtaaggcggacaacactaatgctaccttattcgctgaaaaccgtatctagtattctacgaaagatccaagatggagtatagtaggaaaaatatgcatatagtttggcctttcctggggtgtaacgactcttagggttttcggttttgataactttcaacacttctttggcaatgacttctggctcatcagaattttcgaggctttgcttgagcattctttccgacactttacccttgattgaatcatatacggccatttcttcatctgcaggagaatttgaattagccatacctgttttgataatatgtggatctatagtactgacgtgaattccgaactttttcacctcgtaatcaagagactcagtgtacccttctaaagcatgtttagacgaacagtaaagagcaccgtatgggattggcataataccacccattgaacttatattgattattttaccgtgtctttgctctctcatatgaggtaacacagcacgggtcatccgatggacaccaaagaaattcgtttcgaaaatggtttttgctagatcagttgaacattcttctactgctgcccatttaaacgcaatgccagcattgttaactagaacatcaattcttccagctttttcgataacttcgttcacagcacttttgaccgattcctcgtcggtaatatctagcttgatcatcttgaaggagtattccttcccaggaatggacccttttctagaggtaccgaaaacttcataacctgcactccgtaacgtttctgctattgacagcccgattccagttgatgcaccggtaattaagatcacttgctttttcatctggttttaacgtatgctgtcaccgattttcgacagcgatatttcgatattggtttaacttgtaggcagtgctaactgcaagctcaaccgacagctccatgtatacatatatacatatatacatatatatatatatacatatgtatatatattgctgacgattggtaatttcttgctatgctaatcatgatcacatggagtttaattgtcatgccagtacatctttcatatggtactgccagctgatgtggcaagattacaaaaccctaaaaattaacattagcttgctgggcgaacgtcactacaggacattatggagaccattaacaaattatttattattcatattttaaatcaatccttcaacagattacacaaacgtacctcgaaataataagatgggtatattaaacagtggtcccttgtttgaattccgggatagatggtaaaccatcatgttcttcttgtgcaactttcttttctgtttcgaccctcctattagatgagaggcatgcacaaaagaaggccagagctgaaaaagcataacacatccaaaagacgtacgtaacagcagcactaaatatctctgcagcttcagtggattttccgtcgaagttttgtaatctatatttcacaagttcattaatcttcttaccgtaatagccctctaattttgccttgttgatctttcgccataaagcgctgataaaggtggttgtggataaaactgctccaatactggaacccaaagatttacagaaactattaaacgctgtgatttctactagctcagttttagcatcagggctgtttttatcaatttgcaactgagaactgataagggcacattgtaaagtagcacctaaaccaaaacctggtagaatccatacaccgatctgcatagaattgtttgaataattgtctaataaagtgcacaccccactgccaattaatagtagcgctatgtttgcgatcatcacatatttaacgtgaccagtcttcttagtaaaaccaccacagaaaatagcagataatagggaagcgataactagggggattaaatgcaagcctgcattccatgcggtgtaacctaaaactaactggaaaaattgcacggaataaaccatgtacccagcaaacaccacagctgctgcacacgttacggtattagcaagtaagaaatatttgtgaccgatcaaagtcctaaccattaaaggtctataagaagcatttgctggttctggattaatccgatcaaagatgtagaagtcatacacaaccgaacatacgacaagtaagccaccaatgacgaggaaacatacgacgaaagctcttttccatgaattatcctcagaaccaaacgttaaaccaagtaagaacaaacaaataccagtacagtttagggtaaacccaatgagatcaaatctgaaaaccaaattcctgacaatagtcttataggtttcaacgtattggaattgttttaacggaattgctttaactagtttcaagcaacgtactaatcttgctgttattgataacctctcagggttgtaagtaaagaaaaataaaaatgcagcagaacctccgacgggcaaactaatccaaaagcaccacctccaagtagcatgtgttgtgaaagcaccaccgatgaagggtccgattaacgacgaaactgcaaacgcagacataatgaccgctatgactatggtacggtttctttcttcaactaacgagcaaccaataatcatactcacagtttgaagaccactaccaccgataccagccacgactctcccgacgacaaggttattcatcgaagtagcagtagctgaaacgatcgatccgacttcgaagataaagattgagatcaacatgctcgattgaaaccccaataaagaggtggcccttccccatatcaaacttaacaacgaattaggcaaactgtaaccagtaatcagccaaccactcttggcgtaacctcccaaattcttggaaacaacgtcaataactgtattgacaatgaaaacatccaaagcaacgatcaattgggccaatacaagtgcgaaaagacatacgtacaacctcatcccagccattatacttgactgagttttctcattatcgctagtaaagacatttttcagatcaactggaacgtcttccgcatcctcacctgctttcttgtcctcgtacttcttactgacaggttcactctctcttttaaccaacgaaaatataatgttaacggtgctgtttttgtcaagactggtactgcttacctgcttcgccaacgatgacatctcttccttatatcacatatgactggggaacatcaaaaacattatcaaccttttgagaaaccaccaataccatcaaattccatgccgttcaaaacatatcctttatacgtacacataaattgtagaaaataaaacggctgttaaattgctatcttttagtttattacctttcatagagatgttgcttcattgaaccctatttctgttcaccactgaatgcacggctacagtcttacacccaaaccaaagaaaagaaaagtaaaaagcacaattaacccaattgaatcaacatttgcaacacctaactgactcaaaaactaaccatagacacctgctaatgaagaatttgccaaaaggtctaagaagcacttttcaccaccattctagtgaacaaaaacagttcaaaagtgcacatgaattgagaagacttcaaagtaactgctggaaaatctcagaaaatgttgccacgggcatgagaacacatactacagttcttggctctaggctacgtacatgcgtctctacatctccaactaaatggcctctaatcgcatttccgtgttaaacggatttgtatgatatttccgttacaatcatggaaaatctgataatcaaaaactaatgcagagctacgcagataaaagaacattttccgtggaaaacttggaactgagaatttgaccagcgatagatagattcctgacagtgtaagtggctcccccacaaacgataaaggagtagaaaccacaaggaagccgcatatctaaatacaaaacataccttaaggagctttcctcgggaggaagtgtcgttttgtgtatgtttttgttgtgctgtgatacgcatttcctcgggcttgtaatcctatgctttctatcagatctgttcattttcatgcaacattatgcaggaaaaaaaaatgaaaatgtcgtttagaacctaaatagtcttttcagaactaatagcaccgcccgaacgagccgctgcgatcgccgcatagaggttttcaagtggttgtagtgtgcattaccacaaattgtaacatcaactaaatcctatcgcgtgaatatgagagacggagtaaggacgggagaataggatcggcaatttatcattattgcaggccagctttccttattgtaccctagtttttgacataaacagacggaatttttttctgttccgagctagttgactcggttgctactaatactgatcacactcgtaccagcgatagcctctcattgaagtcacaaatataaataatatgataaattaacatgcacgaggcgggaaaaataaatatacaataacaaaataactgttcaagattgaatgactatggttcaagaaatcaggtgaaacgtgagttcagtcttcttcttctccctcttcttctttttcttcatcatcatcttcatcatcatcatcatcatcgtataaaagccagtcttcaaaaccgtcttggaacaactccgacaatcttctttctacttttaataagttatgctctttcagtgagcaatcaacaaattgtttatattcatcttcggtcaacaaacagtcatccaaaatttgtttcagcttgacgctgtcaataccagtaccaataaagactaactcgttccgtctgtccccaaatggtccttgaaaatcccttttaatcaaagtcaatgcttcaggtgggatatcttcttgtttgtctaagccggcgacatggaaccacggtataccgcctttcaatgttagcattggtcctgcagaggaccattcacctcttaataaatatctggtagctaaccagaagaaacctttcgaacgaagcaatggtccaaatggagagtttttcttgtttctaatcaattctctctcgcttaattcctcttcgtcatcgtcatcaccttctgattccgattcagcttcgtcctcggattgtaataattcgtggaccttggaagtatcaggagttgcagctaaacttctttcttcttctttttcctcttcatccacttcgtacaagtcaacgtgttcttgttcagctaacgcttgttgttcaattatgtaaaatttatccttcaaagcatcatatagacgttttgggtggaaaggctttctggacttgtaaacgaagctattaacaccatattctacagtttcaggagttggtgacaagacactcttagtcttgtctccgtaaccttctttcagagtcatttcgttgatactcttcaaccaaccggcagaagaggcagccttctcaaagttgtaaagaccagtgtttaaaatttcactcattggaactttacagtagctggtcttaatgatcttggcaacaagattcaagctcttaatgattttttgaatctttgtcaacctcttttttttgatacggtcagttttgttgattatgatgacatccgcaaattcgatttgatctatcattaaatcggtaacggtacgatctgcctcaccttggccactatcaccccatctgttggccaagaaatcagtggtttcaatatttgcaaggaaattcatggcatcaataactgtaactgtggtatcaatcttggtcaatttttctagaccaccaagatccaagactttttgtaacaagactctttcatcagaagtaacagaatccggagtgtccaacaaagtttgagaaaattcactagagaatgtttccgcaacttgcatcggttcagcgataccggtagattcaataagaatgtagtcgaactcgttgttttggtgcaaattgatcaattcctccaacaaatcaccacgcaaagtacaacaaatacaaccattctgtaattgaatcagtttttcttccttattagcgactttatgatccttaatcaacgcagcgtcaacatttaactccgacatatcgttgataatcacggcaactttcatgccatggttgctggtaagaattctttctagcagagtggttttaccagaacctaagaaaccagataagattgttactggaatgggaccagagtgagccttaaagggagcagattttttagtgatagacggcatgtttcaggacgatcttcgattatcttttgcctttttatgagataattatgcacatatatcaagaataagactgaagccaacaagatataatgagacaagacggagcagaccatagaccttcagaagtggacaacctttaaatacaattttttttttttacttcatgtcctcatcgctgacactgaagagatgtcaggaaaatctgttctctgagtaattctctgcgctctatattcgggacttcaaccgctaaccctcggcgtatttcctttaaaaaagaaagagctcctacacagaacacaggccatctcaacttatctcagtactgttaagttacaacctttctctttttttaactcttcccattaaggtcatcgccaaataaaattggctaaaatcaaactatgaccggcattacgtatcaaaatgctcactaatcaaaaccattcacgcgcgaaacaaaatttttatcgggaattttactggtgcttatggaactcgtcagctcatcgccgatgtgcccacactctggaccatatgttaccgcttccattaacctttaaggtacccttaaagtaaaagttgaaggtgatgagaaaaaactcgataagcacaggcttcgaatcaactgctcacgtgatttgaaagaaaaacgaaaatccacaacatgctgcctgcccaatgctaaaaaggacggcagtttgaattcaattcaggaactcttactacgttaagactaagaaagagaattctgccggttcataccagccgataccgcccaaaaaaagtctatcttttgataagtacactttatactttagacagccttctttgcaatgtcgaaaacgtcccatacctgacagctctcccatatatttcttacttcacactcattttttgtattttttaccacagaaattcgccaagacagatcgtctactgctagtgcataataggagggagatcttatagcgtgctgatctttatattcattttgagaaattaaaccttagcgatgcgtaatttaagttcagctaatacaataaaaagttgttccttcaccgaaatatgcaacgaaggctactttgttcttatcagaggaaaaaaacctttagatattgtcgtctagaccaacaatgccttttttagatctatctatgacgtagaatgtcgtcgaaaatagggaattcccatgttctagaagcacatttgttccttcaaggaactggctaccgacatatcaaacttacttagtaaaaccccacaatcacgtttgtagataatttttttaggctttacgagtcaattcattattgttttgttttgctttgttttgttttcatcgatttcgtgcattttctgtctactccacatcattgtaccagtctgaatctctgcttgtttttttaacggtctgcagatcttctggaaattcggaatctttcctaatcgggaaaaccgttccaagcttatccctcgaagaggaaaacagaacatgcagaaaagaccgcacaaaagcggttttgaaggctccaaggtgtttcaaatatgactgactgtttttggttcagccaggtggctgcaaaatttgtaccgtggaggctctctcgtcagttcatttttttatccactttttatcctcgaactgctacgatgttttcaatcgggagatctactacgcgaacgcttgtttatgcgcgtcctctatttcatattttttcccatttattaagcgcaatatagcagatattacatagtttcctaagtaggtctttttccttcgaatgatcggaattgcagtcaacgattcgtaaatttaccttgtttcgagaaagtgcgcaatctgaaacacccgtattcaataacaacagaagcattcagttatatttatgggctcaattagacacttgatataacacaggaattaggcattgtacgcatttttgaaagtaggggagattctagtcgcggtgtaccgagtagtattgtccgttttctgtgttcgagagtctttgaaattttttttttttttatctttacgatcgaggagatggcgccatctatgtaaacaaaacatcttaatagtagaccggatatctatggcctgcatctttgacttactgccatccattaaccttcttatataagcataaacaatcaaacaaactctcacatacatatatatttgtttacatatagcaagtactatttgttttgaccaggaactgccaaactatagcagttgtaagtgtttggtaactttaatccaataactaataaggctggaataagaggaaggataagttcagttttgcaccgattggcatcgaacagctaataaaggagctattgagtaaaggaaaacactagctgagatatcattccggcttgccataaattgaagactttcaaaactactctttattcttagtttagataataacagaaaaggaagtactggcttgcacctattctgtttgaattattagaataattcattttctggaagcagcgttctcggactcattggtgaagtacatttcaatattcgcataactgacatcattttcagttcctcagtctgagtaactcatcacaattgaatctgattgttttatgctttatgtttttggcatctcaatgacaaatattccaaagtcactaaacataactaccacggcagacagcttcatttctcctggtagtagtaaatcattcatcccatcttcagtatcaagcagtgaactcccacattcacggccagcagcaactcattgcatcttttacaacgttatacaggactatttgcctgtagatgaaagtcaatggacacctagtaacgttccagctccattaaatgtgcgaaagggagaagtagtacaatttgtctgtactcatgagaataatacagtggttgtgaaatcgagaaataaattggggcacggattagttccactgaggtgcttatcaataaatttggaattgacatcaatatcaaatatgccatccccaaagacatcacattcaccaatattcgagtctcaaataagccaacgactaagttcagaggacttagctcaagacccgccatctaaatcgtattcattgtcgaattccagattatcatccgaatcatccatctcaaacgtgtcggattccacgaacccaatgccaaaatcttttctagctaatgattgtaaagtggtatctgttgcaataaaagacaacaggatgtggtacagagtggaaacaacaacttcgtcgcaacataaaaggtttctttgcagatattatcaggatttttatcagttgcattgccagctgcttgacgaattccgtagactttctctggatcgaaaacatttacctaacttaccaaaaccaatggcaaattcaaagagcaatgaatcagttcatagtcgtttaaacagtttcacggcttatcttgaagtgcttctatcatccgaacatataccgactgattttaaacaatcaatattttatgaccagtggttgtgccctaaatctggagatttggtacagacacctagaggatctctatacaaaagcataataattgatgagaagggggtcagttggaataaaatattaattactgataagaatgattcccaggatcttgtcacagagcttcttcacccagactcaactgttaaccgttctatctcgaggtcctcgacaccattaggtttatcaatatcgacaccatcgtcccccaacatatctcaaccattacaatacacattctcgtcgaaatcaatgtcacaacccagctcaccgcttctaaataagatctcatcttatagtcagatcaataacatcattaagatgaagataaatttcggcagtgattgttatgcaatgaaatgtcaaatcagtgacattgagacttgggataagttcgaacgtattattcgtactcgactgataaaagaccttccggatcccctatgtccattcactgtgaaagtgaaagattcaactgcagaagacaaattgatcgggctggatgctgccaatttcgatatcgacaacgttatgttcatgactcaaaaccaatcaaacagcaacactaattcttatacccaatacaacacaacgataccatttgccaacgctgattcaagaaggcagttccttaaactgaacctagaggtcagtatttgatcatctttgtgatcaaagtattcctgtcagtttcccataatattctgtttttctgctgatatattttattctaatagtttaaacacactttcgagtagccatatactcttaagcaatcctagtaccaccttatataatgtcataattttacgtgttgttttgtttctgttttttcaaatctgatggttgttacaattcttgccttaacgtgcaactctacttatagtactatgaaagggtgtataaaagaaaaacactgctggtgtaagacagtaagcacaaagacagcaagcacaactactaccatgaacttgaatgtttgctcaattggaatcaatatatgaaacatctattttaaaaagaacatatgcaattacagtaacagttagctgagtttaaaactgaggtgcaaaggttaaaatctagaacaatgatacatacaagcgtgttatatatgcatactcaatcagaacgaacccactaaagcaagctcaaaaagtcgttacgtattgcttccacctgaagtcgttcattcacggattcaatcactatcttcttccaattcacgtctctctttgtccttgtagtacatagcaacagaataggagttgatccagctttcattggcatcgttcaaattttcattaatctcttcacaacggtcactgagatcgttcatgcgttgctctagatttggtgtaggtttcttcttccattcatcagcaactttaaggtactccttttcggctgcatctgcctctctctcaagagcaaacctttcctgcaaatggctgtctgcctccttttcatagatcctttgataaacttgggttggatgggtgattggttcaccgtcactggaatcatcactctcgtaagacatattgtgtattaagtattgattagacagtgctttttgtttgccctttcttcttatacttcccgtgatttacttggtgttttgtatccctttgtgtgtgtcatttcatgattttaaggtatttcaatatttcagaatcatcatttcatacacattcatactgaacagaactatagacctgttaatacaggaaaagtaccacccccccaaaaaaacagcacaagattaagctccagtattacttgcagttgctgctaacaggctatcagtgctatatttaggaagcttcagacgataatgagccaaggcaagaaggagcaaaaggtgagaagcgttgttccattggaatcgaatccccaagtgtttaccaattttgctaacagtctcgggttatctagtgattgggcattaatggatatttactcgttaacagatccagatctattagcatttattccaagaccagtgaaggccgttattctcctcttccccttaaacgagacgatagattctttgactgattcgttcaaaagtgatgtaccagaatcgaaaaatggttctagtgcgccaatttggttcaaacagaacgtaaggaatgcatgtggactttatgctttgttacactcgttatccaataatgcaaacttgctaactgatggttctatcttgaaacaatttttgacagagaacccggcaagtgatggtcagtattctgatgacgatgcagtcgatgacttcttggtatcaattagcgagatatataacgaaaatagtcagcaaggtgatactgctgctccttctgcagaagaggatgttgagttacatttcataacattcattgaaaaggacggcttactatacgaacttgatggaaggagtaaaacaggaccaagatgcttgggtaaaattagtcccgattcagatttattgactgaaccactggtaaaacagagattcgaatggtatcacggtaatgcttccgagtctatgaaattgcagttctcattgttagggctagggccatctctagattagcatcaatatgactttgcaattaataaactgccgaggttcatgtgaaccatggtttgaacgtcattaatataaacatatgtagtagtgaatggtatttagccgaatcatacgagatattcttcgaaacaacttaaatttgtcccttgatgtcaattcttctagcatcgccgaaatgtttaatgattgtagaacggcagcttttacaatcgagatagatctcgttggggtcgctttccggcacaaccataaactggattagctcaagttccgttagaaattcgaaggcttctgttgcatcattgaaatgaagttcaggtgccaagaattgcaacggaagtcttgcataagctttacacatgcaattcaatgcgtttaatctctcctttttaatgaattgattaactaaatggcgctccgggccctttgtttgttgataaattctcatgaaggtatgatagttattttcaatctgtgcttcagacatttttaatgctctttgtatcatttcattgtcatacatatgacttagggtagttaggagttggaagtgcaactgattaatgctggaatggtccgaggtcatcatgtggtagagtattctgtaactgatgaattcgggcaagtcgctcttgtcaatgttatctttttcaaacaaaggcttcaaactactttgacattgattatattcaccgacatctccgttctcaagagctgcgcgtgcatgcgtcttataaacagtaacagtaaaatcattctcgatcatttgcactttcaagtcctgccttatagatttcaactgatcacagaaatactgataagagcacgaaccgctatgaaacttggtcacaatccagtcaagagctttaattaaaatggacaacgggcgtacttttgccggatctggttcagaagtaagtcttaaatattttttctctaacacttgacattgccccacaatcggcttgttcttgtcaaatttataagctttgttagtgatggcgttgagatcggaatagctgtcgtcgtcgtctatcttcactcttttagaggttgacgttagtggttcaggactagcaaatctctttagcctttccagcctcctgcttttctcatcttgagcagctattttcttgggtacgggggaagggcttggtgcgttcaagtttgagattcgagattctaacgatactgacggtaccggtgattctttgggattcatctgctgatttagcaaaggatctgctgttctaacattctgagcccatggtggggttggcctagaatcaattggaggaggcggcggtggtacctttgactgcgtttcaactgttactattgaagtaggatctatcacttggtaattgttagtattgtctttagatgttgatacatttggacgttcaatgccaagttgttcatatgggatgccatctatgataattcttttttcttcaggggataagaaacagcatagccgttcctgggagtttattggatttccgttagttttcgctgaaaatactcttgttaagtgctgctgatcccaatcatttttatgcagagctcctttcgcaatagctgccttgagtaaaagcctgatttcacgagaaacaagctttaaccttttattaggtaacctcaatgttttggcagctttatactccttttcaacaaaccggtaaaatgatggaggtagaggttcatttattaagtgagaaataggttccaagatatgatcgaattgggggatatagtcagcttcttccttgttagtcttggcttccttactaagtgattcattgatcatggctttcttacgttcactctttagcctagctcttatttccggtatagagttaccaaaactagatgttacatttcccgtattgtgttgctcaggagggagtgagctttgccctccagatcctgatttgttgtacttattggaagatggacgctttcccaacgttattggattcacctggttgtacgtgttcattgctttataagctaattttgaccaatatattaagcgtaaggcgagccacaaccgtctgcaacagttagtattggttagtaggttttatggtagtctttttgccgtgaattcttagtttattactcagtttcattgggttttgtagctcttttgccagttttcaatcagtattttttcagtagaaaatgagccaagtactcagactgaacaatcaatagtgtaaactagacacatttaagactttgaatgtgtccactcaccacttatcagttaaataaatgtcactcaagttaactcaaaatttcaacctttcaaaggaaatcacttccaattgacctggcacattattatattgcacaaacattatgtaaaatatactttaagctatttatctgacgcatgcactaaggcatcttgaaactcctgttgcgacatagaagagcatgtctgtttcgctaattctaagacaagaccagtgagattgtgtctgcggaatgttatctcttcgttccatttttctcttttattcagttcctcttgcaactgctccgcaagtataaactcttcgctatcattaatgtcttccttctgtagttgattttgtaagaactctagtttgtcctttattacaccaattatgttgaacttatgcactcctaattgaactaaaatgttcattctttcctgcaagatgttttgcacatctttggcaaagtcagtgaatggaccatgatcaatagggtatggccttaaaccatctaattcataaattcttgatctgtatgggataaacccgacaaaatggaagacttcttctggttttcctctgttcctgtaaggatcttcatccatgacaaaaaggttaggtggtgtaaaagaattatgcacatttcgaatcaattctgaattattgattgtttcaccaatcaattctgcttgatggaaatccttcacaaattcatagaattgggacaattctggacccaatgtaactgattcttcatcttccttggctaaattaaacaatatgtttattacagcttgcgtcgcacaagcattctgaatagtttgctgggagaagaaaagtttatcactgtctgtttcatatgtaccctggacgggctctgaaccctgatacaaggaaacctcataaggaaataaaaacaccacacctttaagtaaagaagatactgattcttcttcgagatattgcaaataaggtatatcttcaaattgcaatccttcaacgcctagatccgtaattaatcgtgtgaatactccagcgtccgattcaatagtgttccagcctgacatagtattggtactaggagaaaatgtaatctcttacctcgtctgatattgacctaagggcttgaatcgttgtgatttttccgttcccttaaaattcttgtgaattcttgctgaaagccaacactgttggtaacttattcaaaatatttcaggttaatactttgtatatatacaaggaataaatgaagatatacaaaaaaataattccatccggcagatgctcattggcatgtagcaatcgaggatatatccagttccttcattcgtcatatgttccaaacgacaacagtccacctccgtagcgtgaatgtcttgagaaataatcgaaatcaatcgacactgcattagaaagcatgacagctctttgatcgtagttcaagaccttatcacttaacatctcttgcgggtatacaccatcaaatgattgctgagaatcgaatcgtacaatatagacaccagtatcagtgaatagttctcttcctatccccacccaatttctatcacaaccagcaataatcttgttgttctcgtccataactgggaattcgaaacttagaaatggtgcatcgatattaccaaactgagtaaactcagaagggttttcgcattctctttgaaacaattcatatctacgacgccacagatgccaattttgcactgattcaccaacaagggttctgttttcatcgggtaatatagccttaatatgtgaattgataaaggaaaagggtctttcaatagtcattaaaacgttgccgtaattgtcaaagacatcaacggtgaacggacgatgtagtctgtatatttgtcttgttatagctttaaagaatccgaaatctctttcttgcatgtacccaattctgttccccatgacatccatgatggcatacttattagcctgttcaaaaccaagcacaacgttcatcatttcgatttgtctctcaataatgatggtaggttcatttaaaatggtagttgcaatgggatcatactgctggatggtcacattgttcatatttggcacgccattgaagcccaaacgagaaacatcctttaccggagttgccactctaggaagccttctgaaagcagaatactgacgtactagagcagcaggctgcgaactgaaaattcgtctggtaagtgctagattatatctccacatggtgtatgaatattgcccggtcagctgttcccttgcatctaaacgtctatttgactttttgtaagactccgtttaaggttgagatacttaattgaagatcaaatatcaaaatattaccgttaaatccaaaattgaagggaaggtaaaagtatcgtcataaatgttctgctcgaatggaatacaaccagaaattccatattacagtataatatgtatgctatcaaatgaatcatataattcaatcgtacaattattgaaatagtttactgttacatacctattgggatacttttattgaaatgtggtatatcactgtgttgaatgagattaagaagagaggtaatattaatacaaagcaacaactgtaggttgagctatgctgggaggatggtcggttgataatgaggatcagggtgatataccatgctgttaaataatgctgaaagaaaagaagactgaaccaataacacgggaatcggtcagcaaatcgagaagagagagagaaaaatgcaaataataatggtaataagttacaagaagtagtccatttgaggttttttcgtagggagaatgacattacctccactatccctcgcctgaacagcttcaaaaatggtgtaatccttcgtcatatcgtcatcgatgcgcagcacagcagccacattcccacaacgataacagtagtttggtgctgaccataccgtgactaatcccccatcgaacatctctttataaccttccatgaccaattgatgagctctagcgattaattcgacactatttgtgtgtaaaaatttatctacttcgttttggccaaataggaaacctgcaccacgcggggaaagagaccaagtatccacatcctctggatccgaccacaataaatcacacatagcaccttcatgcggtacctcctttttcctatcgatggttcgtatttcgttgattgataaaacgtccggcgataatccaccatgaacacagaaaaccttgttgtttacaatggcacccaagggcaaatagtcgaatacttcgcaacagtatctccatacgttactgttaccatatttccttaccacttcgtcgtaaaacccataaaccttcgtaatctgtcttgtttcatgatttcctcgtatcaacacaattctatctggataccttaatttataacataccaaaagaaggaaactctctaacgaatagaaccctctatccacgaaatctcccaaaaagatgtatctattcttttcaatgcctccactcttagcaaagagagtcaacaaatcatgcaattggccatgaatatctccacaaattgtgactggcgtatccacatgtgtcacgttagactcattcataagaagttcttgagccatgacacacagcgagtatatcgaatcctcgtcaacatgtttcccctgccttagagtctctataatctcatcgagtttcatcattgacagatgctcagacgacgttaaagttaaaaccaactggaagtataaaagataaaaaaaagtgattccctgttcaagaactgacgatattattctatagtgatgagtttggatcaaatccaacaaaaacctaccttaaactaatctaacaaaggtaaactgaatagtcatcattaacaatataggcttaaaagcttctttactttcttattttccaaaattcgatgagatagacaaaatgcaagtatcaagagaaataaaagtatcaagtatcaaaagaggtaacaacaattacatttttcggttagcctgaaaagtcaacttgtcggtctgcgctttccggtatgtctacagtatatagcgtagtgtggaatgcttgcctgtgttgtatatgggaattgttcagaatcttgcttcttcttcttcttctccttccattgtttctttttttttgcctgtactcttttttcacgtttctttttatcagtttgcttccttttttgtgtttcggccacaaaaacgataatttaacgtgacatgcgggtaatgaggtgtgcttatgtaagccttcggaagatgacacccagacatcggaatggcggtattcgtgcgtggtgatgtcaaatatcacgtggttgataatgtgcttgtattacccggaaactgcatgtatgtcccgtgcgtggtaattgagaaaggcattgatcggaatcaacgcgtctggatagatgaacggaatgttaaaatgtaagttgctaccaaaccaagctagatactgatcgcagctagccccttgatagaatgcttcgtaataacctggaccaatggtacgagtacaatacctcttttgtagagaaattgcatgggaagtaccccaatgaacagttgaatgaatatttgcaaactacgagtacgaattccctgatatccaatagacaaaattcggagtgggatgagcttccaatggatttggattcccaattgaaattggaatttgcattgtacttgattaatgaatctgctaacggttctctaagtactaagggaactactttcttacaaaagcttggctcggtagacgttgacacgttgaaagaattagtccaattggtactagagaatgataaatctttagccaataaaagcactgatgaggatgaggggaaagtggaacagatcacctcctacctgatctctagctccatttctaaaggtatcaatttggcatcaatagacaattcttccaacgaggagggtgtacatgatccaatctcattttgtaagaaaaacatcgacatcctgttggatgcatacccacagaattcaagcagttctttgcaacacgcgcccctttctacctcagaattggaacttaacgatatctcaaaacaacaggacctacaaacggctatcacggatttacaacttgcatacaagttcttgaaatcgaaatatgaaaatgatagagatgaataccaggcgactatagaaactctgaacaagactaacaaagagctttctgaagagctcttacactatcatagtaagttgaaggagcgcgaggagaaatcgaaagtcacttcacagatgcaatcaattccaatggatatcgatagatccttctcacaagcaatttccgaatccagtgacatcaaatcctcaacatctgcttctaaccatcaatctttctcaatgatgaagcaagaatttaaacgaatcttagctgatactcagttaagatacgaaaaagaactagaacaagaacgcctgttgagacaacagttggagaacaagttggaaaataaaggataccgctaatcgttttatgttgcccttaacgatccaaaaatactagcattaaacttcaatatattgttgaaatgtaattaactttgtaacattatctaagacagaattcctcatccatttcaaactcaagctggaaaccatttaccgatggctattagtcgttaaatttgtgtatgaactatatgatacatagagtaaggtgccaataataaagacttctattatagcagaatggatatgaaaagacaataaggaaggaaagatagaaggaacaaagggttttcttgcagaagacgagacaaaacctccgagaatcgaattagtgcattgtttaataaaataaaaaaatgaatttttatagtaccatccaataaaacatcatagcttcctgaattcactcaacacagggtagatagcttcaaacgcttgatagatttcttctctttgtttggcaccagttaagacaatcttgccggaaacgaaaattagtaacacaatcttaggtttcaccattctatagataagaccagggaataactctggttcgtatgaagagaaagtaccgtgactgaatgctaaaccttctaaacggattgggaacttcacgtcacatgagccgacaatattttggatcttgaaatcagtaaacttggcactgaacccaatcttttgaataattctggcatattttctactagccaacttggaatcatcctcactcttagcaccagtaacaaccatcttaccagatgcgaaaatcaatgcagtagtcttcggttctctgatacgcataatcacagccgcaaaacgctttggattgtattctgcattacgagcgtgtaatgctaccgtctttagatccaacctacagtccaaattcacagtggccacaatattctgtagggttggtatgattcccgaagtggcagaacctttatctgcgtcttccgcattagcatctgttccaggtaaagattcatgttcttgtttttcttgagtttcccatactgatcgtgtacttggatcaaatactatcttgttttcctcttggaactgtttcattctattttcttctgacatcttcttctaagctaagctgcggtagtagagtttaacttgatacgatatactcggaacagttgataataaacgaacgctgaaagatggcttcttgaagtatttcaccaaacaattgaaagtcttgaaaaccaaagaagaaaactgtcttcaaaaaaaatagatcgtgtaggagtagcagatagtatacaagtattgatataacttaaagggctgcctcagaaatacacgacttaaaactgcaatctttgtgtgttgactggtttttcctacttgttctacgatttatatttggtttcctatgttaaaaagttgtaagcgggaaagaaatctgatgaagctaggtcacatgatcaattttcattagtatgatgatgaatcaccagagtagacttctttgacttgtaaacagttcaatcatgtcatttccaaacctgttatttgatgaagttataccatgtcgatctgagtacatcggtggtttacttattgtcttctttttgtcgtggatcctggttcccttatatatttcaaagtttcatataaccattttgccctagaataatacacgtcaattaacgtgtctcaagaacagcatatgcccatgctgaaaatagcttccgattgatgtatgatacacaatactagctatggacaccttcaaagatgagctgctaaacgttccgatctcttttgatcaaaagtccttgagcagaaaagcacagcagttagatttgatatatcatctctcgaaacagtacactttgactgcacatgatgttgttacggaaattgaaactgaattggaacttcgtcagtattatacattgataaatcaggctatacgatgtctgcgatatttgaaggatggcggtttccagctttcattagagcaagattttcagatcactaacgatcttgttacgttattgattgaagagactcatcgcattgatctcgcagagcaatatttttcagcactcagagagaggttgcaaagtacaacatgggtcaatgagaagatgtatgtggattacgttcttctttgtaagatcccgctgtataaaaatgatccaagtcataataagattgcactacgaaatctatccaagcttatatcaaagctcgatacgtctctttggaaagtgctgtttcaatattttagattgcagttgattccaggcaatgaaaggaagttggctgattatagagatattctgttcgtgatcaaaaaccatgaacaattccatttcgttgtgatgtgttcgtttattaattactgtctcgatgaagggatcagcataccagctgatatgtgggtttattttagtgaaatggacacagctcatgtcaaacttaaaatatggaaaatactcttggagctcttagttttaatcttcaaggacattaacattactgataagctcacagaactgaaatccttctttgacaacaataaagataaaatcgatagtccattggaatcaattcacctttttgacactgtatcattgaagcttgactttcctgtattcggatacaaagatgtaaaaaatttgctattattctttcaaagtgtcagttatttaccgaattgtttcgacaaaagatcaaacttctctgttaagttcttaccgaaaactatatcaacaactggaaagctcctttcctccttggatgaaaaatgttcactctccaaattgaattctttgcacaaattttatcacactttgttggacctggtgaagttctatcagacctgtgaatcaataatcctacatggtatggttgccgatgacaatactacttcgccataccaagacttgcttcaagcgtggaatgcacaacttagaggacaagtgaagacagcatcagctatttactattctatattacacaatgatttaggaaacagggaattgaagttactgtcattattacatctatacgccatcacgttggctgaaatttcagagtgtgatacaggaaacgacgatctgcacacattaacaaccaaggctaatcaattggtttctcaattggatcttctattaaatacctcagtttttagtgctagtacagtttggcgcagtacaaaattattattggtaataatgggaagattcgagcctttcaccaaaaacccacaagcttccaatcagaacacattacttttaaatgagttagagcaatattttgcaggaaatagtttattacctgcggacgatttacccacaagtaaggcacctgtcaaaattaaaaaatcgttactgctccacatatggcttaattacatagctggttccatgtctattaatgagttagaccaaagatgtgttctttctagtacctgtttcaagttagcaaagcaacaatatctaccgtacctaagatatcttgtcggtatttggaatttaatgaataataccattgcgatgaacagcaaagaagttgctttgacaaaagcaaggttagatcaaatcgtcaaagatctaaaagccaactctgacactgaaactacagccaatagtacatcatagatttatcatatgttatctataaatcttaaagaataacttcaatttgcataaaataaaaacgactaaatactctctaatctactggaatattaattattcttggatgactttttcagaccattgtttgaagatgtcgatcttttcatggcatatgcagcacttgcttgctcagatctcaaactactttcactatccttcagatgtcctctatcatctagatcaacagtaccggcactttggaataaagagacatctccaacaagtaaccctagagtatctagcacttgttgtggatcagtgaggtaggcttttgcgaccgtctttttggaagcagaaccaacagtaacaggatagataccaaagccatcagaggattcgaaattagggtatttctcgtcccattgctcttcaatgtggttaagctgtttaaacatatcttcatcggttacatcatcaccgagacaaagaacaaactccggcagttcatctcttaggacattttcatcaattgagaagttatcttcgattaattgtttcgctccatgaggtgtccatactaatcttttaacaatctcacctttgtttacaaaacttggacgaacttcaatgtttgctttaccttccataacttcgacgcctaaaccatctgttattttctctagtgaagttttcaaggcgtctgcattaaactcacccaattgtggatcagatcttctatagtgccacgtcaatgcaacttttttcctttcgatgaatgaacctggagtcttcttggtgtattcctccattatttgccccacctctttttgccacgacatgtcaaacttagatgtgagattaatccattcctcactgctaacatccttcatgaaacaaccatgttcagcacttaaacctacttgtggtattttggtaccaaagtatctattcaaaaactgttgatcacgacctgaaatgagccatatcttattcttcggatcctgagcaagtttggttattatagaatacaatcttgcacttggaatagcagctgcaggatcctgcacgataggcgtcaatgtaccatcataatcaaataagaataaacgtcttttggccttcttataagtctttaagagcaaaggacgattcaaggcaggtgtaatcttttgatttcctatcttatgttcgacaagatcaaccactttacctaaaaatttatctgtccaatcttggatcgtaggaacttctttccgcaacttcagttctaatgtctctttttgttccggtgttaatttgagtgctttgtttatagcctttgacacagcaaccgcatcccaggggtttatgattattgcatcggttaggatcgtagaagtaccagaaaactcactcaaaatcaatggtgatgcgtaacaattatatttggatagttgtgatttaactgtgacaaattccaatgcagttgtattcataccatctctaacactggtaatcaaacaaacatcagctactcttagcaaggagtaataaacatcttggggaattctcaggtaataatgctggacaggactatagttcaaattaccatattcaccgtttatggacgacaccaattcgttaacttgagactcaagttttatatttgcatcggttttagctgttggaccactgacttgaatcaaaaccactttaccccgccattccggatacatagctaggaatacctggtacgcctgtagcttttgtaaaacacctttgacagtatccaatcgatctctaccaattatgattttctttccctcgtaagccttcttgattgcgttaactttttcatcgacatctggagagaacgcatccctttgtatttgctccgtatcaacaccgataggcaaagagtcaaccaaaacgtcaccaccataagacgttatccgatactcgtctgagttattagcgtttgaattgctagatttcgttgcagtacaacccaaaagcctttgacaactggaaacaaaatgtctagcgaaaccgtcgttttggaaacaaattctgttggagcctaagagaccgtccaggacaggcttcctcctggaaagacatctgaaatattcgtttgatggccaaggagtatcatggaagtatgcaatggttgcattgttgaatctcattcttaataattgaggaagcaacatcaagtagtaatcatgaacccagatgatatcacctggttgataaatttgggccactttcatagcgtaagcttcattgaacttcacgtaatcgtaccaccaaacgttttctaaagtaccgtcatccggtgcattcaagatatagtgcaatgcaggccagataacgttttcagcaaatttcctccaacggtattgatccttccttaaaagccataccggatgaacagtgtgggtgcaaccctcagcttctttcccttgcaacatggtggcaatgacttccttttcagcctgcgtcaaatacatggatctatcgggattctcatctgagttaaggatttcaccggtccatgcaacgatatggtgttcccaattaggtgactcgttcaaatatttgagacttgattgcaaagcggaattaccacttattggttcaattgaccaacaggatggatcgttagcctccgtgtcatcatcacttattttctcaatcttatagggcaactgtgtgatacagttgataaccttgttggacagtttcttctctccagtcattgttccgaaatctttattcccaaatttaaacactcatacaatggaactattcccccagtccaatcgattgatcttctatctaatattataacgatgagaataccaattagaatcagtgctaatctaaatatactcacgaagcactagtacgtttaacgtaattgacatacttgtatatatttatatttatttgtccatatgagaggatttgataatggcaatggcaatggcaattgccattgtcatatcatgatggcacggacggaaaaaaaattcaggaaacttgagaattaaagggaatatcgaagacagataaacatctggtgatgtctgtggaagcctatcaaggaccgcaatcgttctatgcttcattgctgcattgctgcatacggtgctgataccggaatggagcaagtattattataggtaactacagagagcgttaaaatgagagcgttttatctatatattatgtatgtacacacagtgtacacacaatgtacgcacagtgttcgttgaagctaccataattggaacattctattcattaatagatacatcttgaccagcatatcctgttgtctttcctgagctgaagcagtgtttgaaagaaatgggtttggaggagggtccatgataggaggttttgctgctagatttccttgatttatctgagatattgtatgtaagttacagtgtattcttttcgtatattggattagtatttgttccatttgttctttggacagcgacgcgagtgtcggtacctgtctgctttcgtacatggttcttgtttcttgggattttttgatcaacatcgagttgatatgaagaagcacttgtattttccattgtagcttctgctttggtgagactcctgagtctgatttcaggtctattgctgggtttagatctgtcatgctgatctagggtgggtgcagggtacttttccgtagtcgtcagtcagtcgatctttttatctttgaacttccttcactgtcaaagtagtaagacgaattaaaacgtgatttgaattattttcaagcggaacgaaaaaaccactaagtatccagttcataatagcgactaaaggcactccaagatcacaaaaatccctgggctgccatatctatgtacactagacactcgtgctctatacggtcacctattcataggacataagtttctaagtttaaaacacattcagtcacgtgtgtaacacgtgactgataaaaaagaaacagcaagagtttctcagccactttgatgacgaatgctcttcctcccttactgccaccccttcaacgcctcaaaatgccaccattacataactataactatcgattcacattattcccccacattatgaaatcccaaacaatgttttcagttacaatagaaaaagctcagccaacaaattcttagccttaggccacaacgaaggacgcataaactgaattcctacctaattccatagccagacgaaaaacgtaccatctctcagtttctctcagtcaagttaccgcatattttcgtgggtttaagtcacaagacggaccagttcccagcgtaggaacctcacccatttcttttcggccctgctggcagtacgtccgatcagaaaatccaccataaaacggttacctttcaactggaaactctttattaccgaaactgttccttgccatattagttcttttcttttcgaattgctttactaaatccgcagccatcttaaaatacgtaactctctgcaaaataaagtattaaatatatatacaaatatgtccatccattttgttgatagacgttaatgccaactagtaaatcttgttaatcttgtgatgtttgatacttcatctagtcgataacttaagtagtggcaaggtattaagaggaatccaggcttaagccacccgctgtttattctctttgccttgtggtttttttcaggtttttttctggtatttctcttttcgaatcattttgcatatcaaaagtttctctaaggtttctcaaggttctatctcatcgtcctttgatagtatttagttaacaagctttctatttgtttgtctgtgtgtggattttcgttttcagctgaaagttccctactccaagacatggagtgcttactttggatcccgtggttcatcaaaagggtatatttgggtggtgtaaatcaacgcaatgtcttcacactggctttgaatttttgtttgaatttctcaccaatctttatatggttgtttatgttcaagaatgcaggtgtcatacctaccaattggcgaccacccatttggggtagcgtcgcttattattgtgatgcgtatatttttggtgattactggcattctcttgataccaggttggaattcgtggtgtctctcgtgagcagtagtatcatcggtatcttatttgctgtggtgccattgttcatctggtactatgtttattataccaagaaattgaggcataacctgttcgatgagacagacgtcttgctacaataccctttgaattatatcggttcatctcaattccgacctagcaggatgagaaacgtgttaccctttctattcttgttctttacatttgtgatgttgaatttcgatcaccttttatccagtcaggatccgtcgaatttcaccaagttcaaggacttattggcttgggtgatgtacgtgattctgcatctcactgggcccattcttactggtgtgtatttgtacgttttccacatcccaggtacgttgaaatgcttctcattcgcattaggtttacaaaatatcgttgggctcttcactcactttttattaccaatggctccaccatggttcatacatatgtacggtgcccatgatacggctcatttgaactacagtcaaccgggttacgctgctgggttgactagggtcgacatgcatcttggaactcatctcaattcgaatgggttccatctctcgccaatcgtgttcggtgccgtgccgtcactacattcggctatggctgtacaatgcttcttcttccttttgttcaggtctacacaaacgaaatctgtgccggaatcgatcgctacggatgctgctcctgtcattcttcaaaaggatgaagatgatgactatgagatggatgaagaacaagatgaagaagaacaaggttatacgaatgttaaggtccaacctaacaaatccattattcccttcgagttcgaggatgacgattttgctgatgatagtgacagcgtcgaaagtaaactcgtttcacatattaatagcataactttacaaacaactaacggtggggatgacgacttggaagcacgcgcaacgacttctgactcggattcagaactaaatacgttggctgttgctaaaatccttgccaaacagcaggttttgccagttcatattctagagtccaaatggctctacattttccataaaggtctgttaccaaaatttttgggtacgattttcgtatgcttacaatggtggtcaacccaatatttggatcaccatttcagatacgatttattcgtcggtgccgtttatgctgtaatctcatacatcttgatcaacaaatacgtcttgcaaccaaaagttatcaagccttggctaataaccagggctgatcctaccttggacaaaatgaaagagtcaaaaactatgggtatgagagtttttgaaaacactaagatcgaatggtttttcgatcccttggcatgatatagttgaacaacaaaaatcaacaaaccttcggatacggtatatcaaacgtctcgtacgtttgcattgattcattttttgtataagctgcacttcaatatgataattattttacatataaaatatataatatatacttacaaaggatgttagtcaatatatcaataccaaacatctgagagagaaaaaaacagcatgcatgttacagatttcgttttgaacatcaatatgcagttccattgtttaatttgaagcaggttttccaccaggtatcaacatagcaatgttgttaccagtcaataacatctttccctggaatcttttaatctcctggtcttccaaatactctaccgcattttcaatgacaacattaacgtaatcatcgaaccctactagcgtaccaaagaattctctgtaatctttaagtagaatggtcacttcctgtcctattgttttgtcaatgacctctaggggcaaaatctctgaaacactactcatatcccgtcgttttataaatatgtgttgatgcagtagtagagcaggaggttttaatagtctaatgatactaatagacagtagttgtcgtcagctcacagctttatctctttgatcaaaggtacttatttcttgaaactttcaaagctctctcaatatgtgattgtatggtgaaagtaagcgtagttggccgaaagaaggcaataaagtaaagaaatgagcccataaaaagccttaaaagctgctacaaggtaggccaagaatgttgtatctattggcatcgacttgatggtgctgttggctacaaaggcttaaacaacatgcaatttcgctaggaacggacggtacgggtcacatgacatctcactaaacacgaacatcaggtgtccctgagacactgttcaccagctgtgatgattggcgttctggtccaagattaagcctctggtgaccattcaacttgccagtccggtatttacaggttctgtcaactttagatttggttatcactcacaaattcctaccaagtggtgcgtaatttctatattcttgccgcaactgttgtttctcctttgtacaatatcaaaataacaattcaattgcaatatcaatcatatatactaaggttttacatatgatgataaggataaggataacaaatacatatagacacacatctcacaagactatcacttccgttattgagcagttcacaaagacatcatatctgtctaacactagttgataaaatcaattggtctaggagttgaataccattgttgataataaggttcgattgattttagaagcaaactagaataaggagcaaataattgtattattgtggctagaattgaagaaacaacattaggaaatcattattaagtattataaaatcagaaaagaattttcactatgtcatcgtcattgccactgcatgtttatattagaccattaacgatagaagattgccaagcatcagtagagctagaggcacaaggcttcccacctgaagaaagggctggaaaggagaagatcgaattcagattgaagatgtgccccgaattgagctcgggtcttttcattagagacgttaaaggcactgagattttgggagaaaagttgattggccatatctttggtaccaagatccccatcccaaaaaacggtaccaaggaattaacttttattaccaacgaaagcatgagtttcacacaagacgattcttctcctgtcattggagtgcattctgtcgtcattgctccacaacatcagaagaagaacctagctactctactattgacagattacatccaaaagatgtctaaccaagaaatcggagacagaattgttatcattgcccataacgagctggtaccattttatgaaagaatcgggttcagatctgttggtgacaataaagacgtcatctcaagcaatggcaaagtttggtgtaatatggttagagaattggtgaaggaagagtatgagacttgaacaggtccttacttgcatgaaaaggaaacaggaaaaatcaaaccatcatccggcagtaaaataagaagatcaaggtggatttcaactctcagatgcaacttttacatgtagtagttatctgagctgatatacctggtaactgctgtattctaacagaaaagtatatataaacgatactaaataagataatgttccttctattgatcgttccgcccttggtgccgatggacctagaaattacagcatccggtgatgtaaagtcaaggcttgccttaaaaacgttacattcgggcttacctcgggattacctttttatatctatatattcgttctcaaacttcaataccagtggaagcgttagcataggagaagcgacatacaccacactatatgtggaggccagaaaatcatcttctagatccagatgctccctagtactgccccgtgcttaccctaaatgcacaacactcttttgctcgcaatctctcgttttctagcatagtctttccgccatcttagctaataaggtaatagcaatctttgtaagtaataaaagaaagaaaaaaccgggatgctgctaacctgtcacaggattagtgtgcaaacgtactatttctttggttgagtccctagtctgatacgtcagagagcgtaccctttattttgacgatcccgagcctcttcctggatgattatataaatggagcctgtgaaggttcctgttcccttaatcggcttctcatttaccccatatatagagtaagtttctgtttgacatatcccatcttatagaaataaagaagaatcattttcacacagcatcacacaccatgatccaattaaccagagttataaagtcttccccagttgctacccaatgtttgagaagaaacttctcagcttctgttatggcaggcactacacagaagtcaaaggatccagatcaaaggatgttcgatagaaataagaagaagctagaagagttggaacacgattctaaaaccgacgatccaaactacaaacgtcctaatctaaaatccttgaagcagaagggtaaggatgccccaatcaaacagcatagagcagatgacggtgtctattaaggctaaacgaaatgcaccctaggatattcaaaaaatacatgcgacaactacaatcttcaaaacgcctacaggtccatgagacctggccttatttatgtaagaacaagagcaatgactagataatcatatataatggtactaatatcatatatgtttgaacaaactgacaacagtatgtcttcctcgaagcatgtctatgccgttccggacgttgaagacgtcggacaaaatatgtgggcatagtcacgtggaatcacgtgactaaccttttcttcattttcccacccattgcaacctcgatttagatccacataaacaatcttgacaaattggatacatacttacaaagggttcagtactgttaatgagaaagttcctgtcattatagaccaaaggtttgtttctggtttacttggtattgttgatacatttggtatttgtgtgcttattcgcatcgagagaactttttatgtttgattccgattactgagtgaggcggactgtatttctattaacaagagcatcaacgataacggatcagattcagtttttgtgatttcaaaagaaacctcgaaggttttagttattgaactgggattttacactcttttcaccaaccacgatgctcgaacataactccaagttgttttgtaaatcactttcgcagctttcagctgtagcgtcgaaggttgtggctgaggatgttgaaggtgaacatttcaagcagctcttggcgaaatgtatagacacgttgtcaatatacaagagcgagctgcgaaaactttcatgtgcttccaaggacacaccaccatcgcagatatatcagttgaatgagacattgtacgtttactataagattgtgtcacagatcgcatctcaggttattccggggttggccgagtttcaacagatcaagatgaatagtaagaaggattcaaaagataaagaattgctggaaatttatagtagattggtttctgcactagcgaatgataaacagataggggaagtgaagaggtttatcaaaaatcacagtgaggaagctgctcatgacggtactcaacactcttatgagaatggggaatttgtgtcaatttcgcagttgcattcactaatacggcatgataacgactcatctggcattttactcgttgatattagaccaaggatggattttaacgatggtcatataaagcataacaacgttatttgcatcgaaccgatctcgttcaaagaatcatacacggattctgatatcttgcgtaagtcattaatcactgcatcggatagagaagttgatcttttcaagaatcgtgataagtttcgacttattgtgctttacacagacactgatgagcatacgaaatattactggcaacagttagaagttttacaagacattctttgcaatagatcatttgataaacctttacatcatactaaggtaatagttttgcaaaatggcgtaaacgcttggaaggagaagtaccccatggagttgaaaaaaataatggaatcggcaatatctgatattcgtacgaagcccgtggaacacaattttcaccctatggcattatcaaacaataataatattgaaaaagccaattcaccgagtcactctcaaactacaagtttcacacattatcctgatgctccattccttactaatggagctagtattaaaactgctggattggtgcctaatcagttgttgccatctaccagtaatttaacgaaagcgttacagcagaacgatgaaggaaattctgaaccttacaaacttcaaccaaatggaatcaaaaaccacagacaggaaagtaataatcatgcgaacggtacaaattgcattgtgagttcaaacgggaataactctgttgctaaatctggtcatcctagtatcaatctggatttcgcgattggtttagtgaatttaggaaattcatgctatttgaactgcataattcaatgtcttctcggttgtcatgagctatcatacatatttctgaccaattcatataggaaacatgtcaatgtgaacagtcgattaggttccaagggtttattagcgaattatttttcacaactagtacagaagatgtatcaacaggggaaactacaggcttataacaatactaatatggagtcaacggctgtgcatccaactcaattcaaattggcgtgtggctcgataaattcactgtttaaaggcaagcagcagcaggactgtcaagaattttgccaatttctcttagatggtttacatgaagatttgaaccaatgtggtaccaatcctcctcttaaggaattaagtccagaagctgagaaaatgagagaaaccatgccgatgagaattgcttcagccatcgaatgggagagatatttgacgacagatttcagtgtcatcgtggatttgttccaaggccaatatgcatcgcagctcagatgtaaaatttgtgcacatacgtccacaacttatcaagcattctctgttctttcagtaccagttcccagagcaagatcttgcacaatttacgactgtttcaaagagtttaccaagctagaaactttggaaaaagacgaattgtggtattgtccttattgtaaacagagacaaccatcaaccaaacaaatcatcatcacacgtttgcctaataatttaatcattcacttaaaaagatttgataatatgatgaataaaaacaacgtttttgtcaattatccaaatgaactagacttaactggcttttggatcgacgattacaatggagaaatgccaaaggataacggggtttcgttgccattgcgtggtcaaaagccacccttcaactatagactctttgctgtggcgtcacattctggcacgctctatggtggccattacacctcctttgtggacaaaggcagagttggttggtgttcttttgatgatgtcagttggagaaaaattagaaggaaggacgaatatatcacacctaatgcatatgtgctgttttaccgtagagttaacatgtaagtataataattaattaagtagggaaatacaaaatgtaatcagtgttcgaagaaacaccagatcggttccaataactactcccaatcatcatcttcttcgtcgtcattttcctcttgcttgatagcttttgattcagttttagcagaagaaatagtctccttaccagtgttggagtcttgtttagcctttgcagttttagaaggaataatttcttcttctgaatcctcttcctcatcatcccatcctattgcttgttctttacctagatcttccttggcacttaataagtcacgcttctttgaggccaaatttagaatctccgccttcttagtgaagtaaatattccaaaatgttgcatcatcaagaggtgctgggacaacgtcttcgtgtaagcttttcaagtccgaatccttgtttaataactcttgaatctcttcaaaatgttcctttattacaaaatccttcggtaagcttgctgcattatatttcaaatatattgacttgtctatggcaagttgtttcaactttgtgtctgtaattgagctaaaagcggtatccttgttagatccctctgcctctttggcatcgaaatcaagcacttcttgaaactgagtagatatggtattcgccatggacgaccagaatgattttttagaaacagtgttccagtacccttgcgtcaactcttcaactttctccaagttgtcatccaatttccccaacatctcttgagccttatttgtaacggtaccgcccaaattctcagggatttggaaattcaaagagtccttctctttaacaaaacctaaaatagcctttgaagttttctggagctgttcatccacttggtcctcgaacttctgaaacgcctcatcagtcttatcatcatgttttgtcaccttaacggcatctgcagtctctgttgcagtctcttcatataagaaatccatcgctaaagacgcttttcacgactaatgctaagctagctattaccaaagtaccttaatgtcaccaaataacacgtctggctagatacgctcgacgcttatcgacagacttctcgcgagaactcttttgttgcgcctccccttcttgaagatcaatcctttaaaggttcaaactccaaatgtttcatgattttccttattattggaccttttcattgcaaagaagaacagtttcaacatgtctaaaatacagtaggaagaagcctcctcatcttgtctctgctcaagtttgggtattatttggggatagcagcaactatagaatactcaatgtcattggtgactcccttacagtttagctgtgttcagccgagattttacagaggatcatatccggcagaaattaacctaccgtttttgaggacccttcgactcaactatattatatctttggtacctgaaccgattactaatgaccctattttagctgagttctgtgaagtggagggtattgagacggtttttatacaatgtgcggatgacaagaagcagaagacaaagacaaagaataaagacgaacccaaggtgaaaaggaagaagaaacctgtacctatagagtacgatgtggtaatagaatgtatcaagtttttgatcgacaagaaccattatccttgttacatccattgttcgaactcgaacacggaagtcacatcgctagtcatagcatgtctacgaaagctctcttattggagcactgtatcgatattcaacgagtacatgacatacacgtctagcataaatatacatgaaagaaacttcatcgagaacttcaatctggagatagatattcaaggtgtgaaaccttcggacaaagtgtcttggataatagtcagatctaagcacaatggggccacgggttcgaaacaggataaaggtgcgaaacatcagaacggaaagagcgatgagaacctcgatctaacaccgcagctatccgcttcaaaagatcctttgccaacacttaggttccatgatgattgattgttatattatctgatactactttgtgtacattacatactctttcagtattaatagagagaatagtctgcgcgcagagttttgggtcaatacctgcttattgaaacaaaagggaagctgcatagtccacgtttccaccagttttattcaatgcattgatagcttctttcctagagaaaccaagatccactaatttttttatgtctgattctgcgaacgatggaacagtttgatttgtggtagaacttggaatctttggctgcttgactttgtttgcatcgccagtcatagcattttttcctgaagatgagtccctcttcaacgctgcctttcttacttcgtcagctgctggagttgtcagtgcatgaagggagtcctttggaatttcagattcaggcaagaatggggtctcaacatctgatattctcaatacattgttcttcaaatctatagatgcctgatgtcttcttaacatgtccaaacccaacaacatttccattggagtgtcaagtacggtaaaactacaaggcaagaacacgtcgtggattttgatttgagtcgtatggattctcccgagaattttgcccgtaccaacaccctgagctataccactgaaccttttatcaattagagaggtcaaccctgttctttctgccaattttgttgacattatagtctgttgagcaccagaatcaacgaacgctttgactgggtggccattgatttctaattttatatacaacattgacacttgggtaaaagactccggagtatattccatcgcatatcgtaattgctcatcaatctcatgttggttggtcaactccgaaatccgtgcttgattcacaggatcatcagggttgctcattaatcttgagtattcagaatttgggataccgaatgggttatttgatctttcaccacgtctggaaagtaacaccggacctagtagttgatgaaattgggttttattatttatcatatgttctaagtttggaagacccatctcttgagccatacttggattctctaataggaaagtcctgaactgttcaatgtactgttcatccgtcaaatcgatctcctgaggttgaccgaaagctgcctgggaactagcgggattcttaggttttatcaaaagcatatcatggttttgtaagccagcctctttcaaagttatattcgtgttcttagtgtcaagttgcttcatgttgtgaaatatgatctgagattcctctttaaagtctatcaatgcgaaaaggtcgataagcgacatatcttcactcaattcaaaaggtccaaggacatcatcagagtgctcataagtgacggtgatgttcatctctgatacggttgcctagtaatggtaactttcagttttagtgtttattttccattgaataaagtgataattgataattaaagttgatcttgattaataaaggaatcttatatgtcagagaaccttaaaacaacttctcgaaagtaaagaaagaaagaacggacaaaagtgtcgccaaggctatattgaaatgaaaaggacaagggatgatatcctcaaggtggatgtggaccaagaatatctggatcagcacattgattcattccgtgatggaatagaacatatcttaactattgaccccacattaaaagaaatcattgagcatagtcctttcaccatgtttctcaaggaaaatgtggccaaggattcgatggacctttattttaataaattggcaggtagcatcatttcacagcagatcagtggtgcagctgcgaagaatattcgaggcaggatcgtagatatgtttgatggaacttttcctaattatcagacactgcacgaaacattccaagactcgaagaagaaacaagcttttaaggaatgtgggttatctcaaaggaagctgatgtatattgagtccttggttggatattttttcaataacgaggattctataaaagatctctttgcctttgcagacgatgataaaatcatcgaagagctagtcgcaaatatcaagggtatcggaccgtggtcagcgaagatgtttttagttacaggtttacatcgcttaaatgtatttgcagctgaagatttgggaatcgcaaggggatgttcaaggtacttggaacaacgaccagagatcttaaagaagcttcacagcaagcggactcttatcaagaaatcaaaaataaagcacaagagtttcaagtggaaaatccacgatgaagacgtggttgagctctgtggtgatttatttagcccccatagaacgttatttatgttcgttctttggagaatgtcggatactaacatggaagttgtcatcaataatgagaaaaggtttatgtcgaagtaataattagaggcattgtaattgctgtgtataaacagtacactttaaagtaaggtaggagttcactggtagcaacttttgagtatatatatttacaagataacatttaatgtgctgcccagtgtttataataaataggaagtaaaggggacaaacaagaaaataattgaaaaaaaaggatccattcgtagttcccaagatcacttcgcaagtttggaagcctcagttaagattttagaagaggccttttgctgttgtgtatagagtccaccggtgaggattctaattgcggctcttggttttctcaattgagaagcaaacaacaatgaacctgtcaataatgccaaggcaccagcttggtgagcagaagctagagggattggaaccaaatataacaaggtaaaaatacctagagtgacttgtaaagtggcaagacccatcataccatgagcagtacgtagaacttgtttaggaatgatagccttgtttctgttacagtacatgtggaatgcaaacacagcgaagaaagtggttgtagccaaaatcctatgattcagttgaaccgtagttgggttttccaacatatttctccaaaacatatcactcttgtcttcttttctagcaaagttttcgtcgattaattcacgtttacttggtacccaatcatcacccatgtgagggaaagtattgtagattagaccagcatccagaccagcaaccaaacccccagacatcgcagtaacaaaggtcaaagctagtagaccaagtgcagatcttctcaatggagctagtgctgggttatctagttttgagaataaaacaagagcttcggatgggtttttaacccatttggcctctctcaagatctcaaacccggtccagagcatacccatatataacatgaaagcggtacccaaatgtgtagtcaatctgtactgtgagacagtcggtttggactttctttccttcaattgtgtttcatccaaaccagacttgaccatccaccaaccgataaaaccttgtaaacctagtagtgctgataaaccaaacaatcttttattaacatgaggtgatgtcttcctagcgacagcaaagtagacagcaggcagaatgaatacagcaccgatagcacggccccatagtctatgaatccattccataaagaaaatgaacttgaattcatccaaggtaatatgagagttcaactgtttaaattctggagaacttttatacttggtgaattcattttcccattcctgctggttcaagggtggtaaagtaccagcgacaggtctccattctgtaatagataacccagattcagtaagtctggttaaccccccgagaacgacaataccaaacacaagaattgaagtaccaactaaccagtaccctaccacttttgatgaatttagcaagggttttgacttagcttgtttagccgtggatgccgtagctgttgttataccattaccagtagtttgcgatacctgtacagcttccctgacaatagatctggtatggaaatacgccattgaaactgttggcaaagctctcttaagagcaacagtgggaatcacattctttgtctttaccaaatttgatattgaacgggtcattaaaccacgggaacttatgcgaataccgctgaggcctctgcctccaagaaccaaagttctgaacatagtgataactaggttgtcagcttcaaaagatcgaatctggcctctgtggttcaatacttacttctgttaatgttactagtgaaaggcttcatcgttccatttttttttttttttatattgagcctgatcattccataacgtgaagggaactatataaaagcgtcagcagaaagaagcccgataaaacgtactattgaataacgagttgacatgtcgttatatttggccagtttgtcgatgttgttaatatctataaattctctatacttatttgaaggccgcatggggaattcgtgtacgttttgtctgtatatccaaataatcgttgtttaagtagaatggtagtacctggggttcattcggcggtggattcgtatcaaattcgtctgtgtttagtttacagtagtgtatatatttacatgggactaaataagataaatgacattgggtttgatttatttagtttccttgttgcgtttttcatcaatcttcttgaagtcttctgaccaaacggtgttacccttgttagtgtctacgtctccgaatagtctttggaaaacatcttcgtaccagtctgcggccaaaggttccaatccttccttcacattctctggaagctcagcccagtctgacaaattgtctttggggaaaatgatagtcttggcaccagatctcttggctgctacggccttttctcttaacccaccgatcctcaaaactttaccagtcaaagtcaattcaccggtcatagccactgttgggtcaagacccttattcaaagccagtgataagaatgaagaggccattgtcacacctgcagatggaccatcctttggtgtagcaccttcagggcaatgcaaatggatctttgcaacttcaaagaatctattttctgggaacttcttggccaagtacatctttgagaaagagtatgctagtctagaggattccttcattacatctccaagttggccggtacgttctaaagtaggttgagttgaatgtgtcaaaggctgttctaaaacactctctacgtacattgcacatccacccatgctagtccatgcaagacccatcacaacaccaggaggagtagattcgtataatctatcagtagtgaagattggtggacctacgtaatcctttaggttgttttcgtctacagtcacagaaacagtttccggtacttctaaggaacccttgttatcgtgagatttttgggtcttgatcagttcattttcttcagtagtggattctacggtcgatgcttcagcactagatttgttttcggattgcttgacctttatatccttttgatccttcacttcttcattttccataggtttatcgtctatgctcaattgtttaacgacgttcaacgcagccttacggtagattttctcaatgtgctttttcaatgatctaacaccactttctctgcagtaatgcttcatcaaagaaacaatagcattctcggtaatgttgacgttagcattatctaaaccagcagatttctttgcacttggcgatagataattttctgcgatcttaaccttttcttcagcaacataaccagttagttcaatgacttccatacggtccaacaatggtcttgggatagtttctaaagaattagcggtgcaaacgaataaaactttagacaaatcgattggaatatccatatagttgtccaagaaactattgttttgttctgggtctaataattctaatagcgctgcggcggggtccccatggataccgccgtgcccaatcttatcaatttcgtcaatcaaaatcaacgggttttgagtttgacatttctttaaagcttggatgactctacctggcaaagcaccaatataggttcttctgtgacctttgatttcagccacatcagtcataccacctactgagaatctgaaaaattgtctgttcaaagagcgagcaatggacttaccaatggatgtcttacccacaccaggtggtccaacaaaacagatgatcttaccatcaaccttcccgagaagcttaccaacggcgatgaactcaagaatacgatctttgacgtccttcataccatagtgatcttcatctaagatttttttcgcctttggtatactgtactgttctttagatataataccccaaggtagggaagtgatccaatccaagtagtttctaatcacaccaaattcagattgtgaagtttcgagagtcgctaatttagtgatttcgtcatcaaatactttttgaactgtttccggtaattgtagcttagatacacgatctttgaaagattcaattaatttatcacgaccatcatctatacccaactctctcttgattcctttcaattgttccattagataatactctctctgcctcttttgaatcttagtttcaacgtctttagagattttattttgtagttcagcattcatcaactctttctttaacactgtcaatgccttttcaagacgttgctcaatgtccaaggattcaaggatttcttgtaattcctcttcttcgccagcagaaacggcagcggcaaaatcagccaatcttgctggctcttcgaaaatatttgtggtggcagattgaattgatgctgaaaaagttgcaatctgttctctgaacatggtattcaattgagaaatctctttaaacactttcaaaatttcagaggtcaacgcattgatgacgggggaattcggattaaattctttgtcagccaaattggatacattgaccaatgaaacatcataatctttcaagaacccggtcaaattctcatcgtcatcttcttcaacatccttcatattttccatcttttgtaaagaggccttaactacctcttgttcattattttcgacaccttcgctcttggatacatctgattcatccttcaggttttgttcagaagttggtgggatcaattcatccaatttgattcttctgtgtgggtataatagagcggtcatcgtttcagcaccagtcttttcgtctttacttgggaatgcgcttgtaacttgggcgaagacaccgacattgtaaacttcatcagctttatgaatcacatcggtatcaacagtagaatccttcaacaaaaatgcaccaatgtatggttgttgacgatctgacatatctttaatcgctttcatgactctttcatctgaaattacaactgctttgtaaaaaccagggaataatggacggcgagatattggtaatgccatcacttggggataaacttcggggaacggttgtttagcgttcttggaaggttttccattaccacttccattgttaccatcatcaccgcttccattacctgatgattctccgttacccgatgctcctccagaagtgctagctgggccctgagtctctgcaacagaatcccgttgctgagatgtttccgattcctttgcagtatcgttgtccttttcttcagtagggacttgttcctcttctttcttcctgttttcagattctggctgatctatatccttgcccttatcatcctgcttcaactgtatgctttttacccattgggattccaactgttcaagtctctgtcttgaaacagggtcgttcatctgtttccgatattgcatccagtgataagactcatccacaaacttctgagaatccgaagctaacttttcgttaccaactatgccattatgctggaacctcgttgcattcatcaacctgacgttgttaccattcttgaattgacgcaaaaggatgttcctggtcacaaggcgggatctactacttcttaacattgtgatctcctttgcacttgaaataaactgagggaaaaaaagctagtcacccggtatcagaagctgttcgactaggtgtgtagtaaactgtatctcaattttgtgactatccgttagaagctgctctattgaaactaaaagtcacagttaaaaaacaccttcgaaaccaaataaataatcacttccgtatctgatttcagttgatcaaaaatcctgggtattagatcaaaactagattggaatatacctcctaatgtatctattgtgctactactatgaaaggcctttttccctcttaaaatgttaccggaatccaagtgttccttagttgtataaattggtatttatcttacaaatattataaataccggtggcgcaaatatcaccggaaaatgacattttagcactaatacggaaaatataatctgtcaagacggacctatcgtaccacttgcttgccaattggcattaaattgtacgttaagatccctccttggtatgtgattgagccgtggtcgttaaatatttaagtacatccatacatatctatatatatatatatatatatagatgcgttttgttatagtgagaaagaggtaatgttacaagtgatccgcagtagaatggcgcgatcccagtggctgttggacgacaatccgtggttgagcttgtgctggattatgagtgctttttgaagacgactgtacatgttctgatgccgatacctctgtgcttgtcgtcgtggaagctgaagaaggcacaggatgaagaggttgctgcctttcctgtgtcacgtgatctgcgtcttctgcccttgattcttcttctgtgtatgaaccttccacatcctccttagggtacatcatctgattctttattgcctgttgttgtctgtattttgctaggtaaatcttgagcacttcggcatagttctcgaatcccaatgcatgtagcgatagaagaatatcttcaccgttaatagtcttacgcttcccactggtacatctatcacaggcctcgctagtgacaaacgatatgaattcgcttacgcactcttgcatacattccttcgcatctttagatacctttgtggtcgctggcaacgtgtttttcattagtcttgcgacgttgttaatcggaagccatcgatcttgctccgctagttcgttaagatagttattatgcctctcttgcttctcagcttctgtctctgtatccatatttagtaggtgtcgctagctctgatcttcataacagaccaaatcagtgaaagaccttaaacacttagtatttttattatgtagttaatagtcatgaatgggtattttaaggtttgttgatgattttgaatttgctgaacgtcaaagatcgagatttttcaatgtatacattggcaaagaaagacactaataagatccaataaacggccagtgctcatcgataggattggtttatactgctgtaggtgctagtgctcagcattgttctttaagaagggtgcaaagttacttcatatcatttggtaagaatgaatgtcaagaatgagcatatgaacaaattcgccaatggagtcttatttctaatgttgggacaaacgttgagtaaaggggttaatttcttgttgaacactttgctagtgcgttatttatccccccgaatttttggtattacctctttcctagagtttttactttctacagtactattcttcagtagagaatcgattcggatctccaccttacggatcaaatctacaacagatagcggcaaattggaaaaagtagaggatggtgaggatacgagaactttgcaatccctgattaattttggttatataccgtttgtgattgggttaccattgtctattatcctaatttcatggcaatactctaatctaaattcgtacttcattgaccttccatacttcaaagcctccatattccttatatggcttagtatattgattgagttggtcagtgaaccgttctacttggtacatcaatatttactcaatcactttatcagatccaaatatgagagtttaggtgtcacctttgcatgtgttgcgaactttattatagttgtctggtttgagaaaatggtgaacggagttgggctagagttgcatgatgattacaaacaagaagggatcgctatttttgcatttgcagttggtaagctcgttcacgcgatgactttacttgcatgttactcctacaattattactcagaggtctatactactggagagcgttatagctacaagttgacaaaaatcaggcctgaaacaagacaagagtcatactatttccaaaatgataccgttcagcacttcaaaaaagtgtatttccagctatgcttcaagcatttgttaacagaaggtgataagctaatcataaattcgttgtgcacggtggaagagcaaggtatatactctcttctttcaaattacggctctttgataacaagactattgtttgctccgattgaggaggcattacgcttgtttttagcgcgcttgttaagcgtatcgtcgaagaagaacttatggttatctatgaaggtcttgattgacctaaccaagttttatctgtacttatcactcttcattataatattcggaccaatcaattcgtcatacttattgaaatttgtcattggatctaagtggtcaagtacctcatttttagaaacaataagaacttactgcttctatattccattcctttccttgaatggtatcttcgaggcgtttttccaaagtgttgcctccggtgatcagattttcaaacattcatacgtcatgatgctcttctcaggcattttcttgttcaactgttggttattcatagaatattttgacctatcactagaagggctcattgtcagtaacattttgaacatggctttgagaatagcatactgtggtaactttattcataaattttaccattacctactaaaagaatcgtcaactgaaactactcaatcaatcttgccaaacatttccaccttcaagaacgttgctctcatcgcagccataatcggtgccctagattggtatttcataggctatgtggaaaatatgcgggaactacttattaacgtcattttggcattattgttacttattttggtgatttacaaagaaaagagcttaatatcagaactgctagctgcaaaaacctatgcggcataattagtaactagttagtttcctttttaacgacatatctcaaattcagttagttcatgatttatatacaggtctcatttttacatataatcttcatcttacggtcgatgtgcattatttgtaagatgcttgctattaagatccaataattcaattagataacaagaactgcagcacagatgcttaatagaaaaagagagtgagccatatctatatacgtgcaactgctctatatagaagattaccagagagttatgtgcctgaaccattgattatggatgaagtgaaagataaaactggagtacggttcgtaactttcaatgtgaatggagtaagaactcttttccaacattatccttttagtaggatgaacaattcattgaaactagcattcgagttgtttcaagcagatatagtgacactacaggaattgaagatagatgctaaaagtatatctaaatggggtaaagtggaaggttaccaatcatatattactatatctcaaaagaggaaagggtacagtggggttggatgctggattcgtacaccatcagaagatgatccattaagacatcacttaaaggtcattaaggcagaggaaggaattacggggcttctccgagtgcaagctaatggcatatcctatcgtgagagttcagaagggattggtggatatactggtttggattttgctgatgaaaacgaccttcttgatattgacagcgagggaagatgtatcatcatcgaattggcttgtaatgttgttatcttttcaacatactgccctgctaactcgtcacaaaccgaagaaggagaattgtctcggctgacgtttttaaagctactcttcaagcggataagaaatttgcacgggttagggaagcatgtcgtgctaatgggggacataaatgtttgcagagatttgaaagatcatgctacggcactagatgaatcatctatttctttatctcaacagaagacgggctctgaaattgaagaaaagtttaatgagaaatgcgttcagttcatcatggacccatctcgcattggaagaaggttgcttaatacaatgctatgcgattccataatttcaaaatatgcacaagagggtattttagtagattctacgcgaaagatacagggtagggacagactaaaaatgtatacagtctggaatacgttgttaaatactcggccggtcaattacggttctcgtgttgattatatctttgtcagcaaaggattaaaggataatattacggacggtgatattttgaccactattatgggatcagatcactgtccagtttttgctgatatcaaggtagataacctcgaacttaaacatgaaagcttcaataagccaaaatttgaggctgccacgagatatttcttgaaccatgggaacattttagatatgttccgcaaggccaatcgcaaaagcaccagtccttccacgacaagcacgggcaaagtagtaaaaccactgaatgtcaagcaatataacggcatgaatgctctggcctcagcaacagtttccaaagatcaaaacaaaaatgtatcgatacagcctcagtcgcgcgtcaagagtgcacatatgaaggctttcgaggaaatgcttggaaaagcaccagtttgtgaacatggtgaagaagctgttcttcgagtctctaagactgacaaaagctttggtaaaaagttttgggtgtgcaatcgatcaaaaggcgaaaaagatgatccagaagcatcttgtggcttctttcaatggaagtaatcgttcttccgtgttccaccattctgggttattattattttatgcatcaatatttatgatttagtttataatctttctttttctttggattcagcttctatctcggcttcggattctaccaatttcttgaaccatattctatcatcctcatgaacggtcaatccggacaggttattgctttgttcgagcacatttattattagtgaggtaccgaccaactcatcgctcgctatgtaagtgcttatggcagtagtaaaaatatcagtatcattgacgcttacctttgcaatagtatccaaattatccacgtataataattcgtactcaattgcttcgccaaatacaccgtgagatcttttcaaagctgtattcaacatttgaagccaagttactttatccacttggatctcattgtctttttccgaatcatgcgacgttacctttagtttaaaataaaaccattctggtttgaacttagccatgtttgttccttgatccttttcgaaaagatgagagattagacaaactctgaacacatactaccggaatcgagccgacatcaatattcgcttctcttgtattgttagttattcttatccaggtttaaatttcacattttcacattgaaaaaggtttattcaaagattaactgatcagaaagactgaaaaaatttcaaggtatgacactcatatatgcctctatgtttactttataaagattataagctgttagtagtgaactacccgaaagttaaattaaaatccattttctatacgaaaattatgtataatgttaaagagttcgagtatcttcaaaaacataaactaggtaagtgttgatgttttaagttgactcatgaggattcgcttcctctgggttatcagaatatggtgcatgggttggtgtatcagatgagaggtcaacttcttcgtcgttaccgatttcaaaattaccctcattctcgatgaaacttgcaagatcgtcagcatcttcatcgtgtccaacaagtaaatcatctgcgtcatctaaaaattgatcgtgtaagagggattgataacttggacctgttgtgtttccaaatctgcttaagcctctcttgaagaaattccccacttggtgtccgaaatattgaagaccggtgtaaacattagagaagaggaacactccgtttctaagaactgtgtttacagctctatcggtattgttctcttctatgaggtcatcatctcctaatctaatttcaccgaaacgagcaaacccaccattcctctttatacctctataataaatgaatgacagcatgccagtgaatatcagaacagcaaagatccatattgctaagaatgatgtatggtttactttatacttctctttgaactctttctcttttcctggacaagggtgaggactatcagagttagcgagcatcaatccgccattgcaggtagaaagagcgatctttctatagccagttggttcgaagtattcgattaaggaattgtctttggagcagatgtctttaggatctgctggttttaagccatcgattaacttgcaagtaccatcagacacacgcatgaaattataatcacattcatagtcatttctggtacaggaacagtttgcaaaaatcctaaatttatcttcgagaggtgccatgccgacataacaatcgtcagactttttacgtaaatattttgccttgtgtccaaacaagcactccttggtgttagggtgacttaatgaaatatattcgaaatcttttagatcatctttcgaatattgacattgacgtgaaaacatgtccacaaagtccaacgtataagttcttgtttcttcgccacgaacatttactgaggatccaattactaagaatctcattgcagagtctcttgggacagtgaccaaatcatatacatttatcttttctgaagcgaactggtagtctttccaagtctttccaccgtttatggagtagctgactgtatcagttggttcgttatctttgacaagcaccaacacacttccgtgatcaccatactcccattgataagaccctttctttacctcagaccaagatataccgccatcgttggtcataaaagtagatgcttcgctcaccggagtcaaatattctccaacattacccaaggcaaacatatagccaatagctgagccagaagaatatgtatccctaacatcttttcgttctgtgaatccatgaaggtttaaggaacacttttctaggttttttgggttgcaattatactttttaccttcagaatccacagatggtggcttgatgtacgtccaatcagcaccatcattgaaggttattttagtttttaatttcttctgtgaagttttatctttgctttcaactatttccttcgcatttgcaacagtgttgatcaatattatcccttcaagaccttgaattttttcaaaatcaacaaagccaaagctgtttctgttgactgctctttctaaaatgacaaaagatgtaccttcggtattagactttagtaatgctccgaattcttcattcttatcaaggttagtcgtcatatgcatgaatattgctccttcctgtgatccaaggactgtgaaggctttttgttcataagaatcaaggtctgcaggtaaaactgcttctgaatattccacaccatctatggttaggtatgcacgtagttgacgttcaccatgcgacactgctactacaatatagccaccagtggacatgaatcctaaaatatcagaatagagaactgtttgggttttgaaatagtctgtagaggacacgtaacttcttgcaccggtagatttgtcttttaccatacaaacaatgccgttttctactcttggactttctacagctgactccaagaattcacaatttgaggctccttccaaaagcttttcgaaagatgcccctccatctctagtaatgtatgctacagcatggcagttaggatcgaaaaaagactcgcaactttcaccgccgtagtaaatgaaagtctgaatatctttagcatggaaggataatgggaaacccaactgtcttcctgcaggaagctcggtaactttaaatgaaagcccgtaatcatgtgttgcgaataagtttttgtttttaccaaatagatatgcagatgagttgaagaaggggttgaaattaatctctaaaatatcttcaccgccagtttgaatttgctttatattttgaccaccatcgtgagacacatatgcttcacttttgtctgtcctgaaaagaattgattcccgtacgaatgtgtcaaagtattgatacgatttgaatatcgatgaaaatttgttttcggtaacttttacattagatggggcaggtacagcagcgcacgatatctcctcttttatgatattttgtggtctcttacatttagttgtttttgatattttcttaggttccaattgaatactctttttactttcacatttttccatgagagatgcttttgaaaaatctggtacgcatttaccagctgaatcgatggagaaatcatcagcgcattcgtagtctagttcgctacagccacacaattcttcctcgaaagtgagatctttgtaagtggtcttaattagacattgagcatcttgctttcttctacggaatttgagaatagtaccgtcaacacattgaccgttagagtaataccaatcttccatatcagaagttttacagctggcacccttgaatgcatcggagaaatcaacgacgtaggacacggactctagattctggtaatcttcagacataattgtaccgactaacatgaatgaatttccggatccgtccaaagcagatggtaataattcagttgggtagaacgatttgtcaagttggtactcttggaatgttttcccttggtctaaggagaagtagaattcgctctgcgggtctttatcagattctggatcaaacggcactgcaagaatgatattaccgtagtcacccattacaactctactcgggaaatcgagtaccttttcccaggtcgaaccatcgtctcttgaaataaaggtacccatttttaagaaatcaccagagggattttcttcatatacatcaccaatggcggctataataccagggctgaaaatatctgaatcaccttccacacctccaccataaacgatgaacatttggaaaccacagtcattggagtcgctattgatatcgcagttgtaattccatttaccttcgggatcacttactttgagcttactccacgtattgcccaaatcaaatgacaccttcgatctaaaatcaaaaaatccaaaatcccgcatagtattggtccaagttgcgaacattgtcttcttaacaaagatagacgtcgataaagtcaacgaagaagctttttgttcatcaaaactcaaatgtctgaagttcttaccgtatgaatctgaaatcaacgcttcaatggaaccggaaaaaatatcttcgaaaggagatttatcttcgtcatcattattatcaccatccttatttctttctctatggtagatggtaataattgctctcccatctatttcgttgacgtccattagcgatttacgaatctgtgttccaagggatatttgttcaaacttatcagtgctatcatcttccaatctccagagatttgcggcagaattttcattgaaccgatctgataatgtcaagataaatagatgattatcggaaatgaacgttgatgctggagacaaatcctgtaattgttcggcaaacggactcaaactcttaaaattaacatcggtgatatacaacttactggaaacatctccgaaaggggatagtacggtactctcctgacagattaccttgtcttttaatttgtacagttttgattttgatgatttctgtacgaatgaacaaaacatgtttaaagggtttgaatcatcattacttttagaaccagagctggccaatttgaaattgttaccatctttggaataaaacgaaatctgccttaaggtaaatttaccatccagtttacctagttcatagatattgataattcttgcattcttatttgtgggatgtgactcgatttcaacgttgataatcggtttacgattttcatcgccgacgttcgaataatcagagaagtctatcttatgattatctgcgtctaggaaagttaactgtttccaagatttccctttatcaccggtagctaaaacgccgttttcaccactcaaatatgcaacatctgctttataaatccgatctagtaccaagtgattccattcctgaggtttgttatcagacgaaaggggcaatcccaccgaatcccaagtaacaccattatcctcacttctataaagctcaacaccacgaagaagtttaagaactactctcgaatcatcaaatccgaggatagacaagcggccatgcgtgtctacatccgaatggaacgataccttgggtttaaaatcctgagccaaaacgggcagaaagttccaaagccccagccaaataaggatattccaccaaaacatgagacaaagacgttaaaagtactgcaagcaatgtaaaagggtttcgtttatatcggtaattgagtatatacatgaaacacaagctaactaccgctaagaccaaaattacaacgaactgttgaacaatggttcaaaagacaatctgtacgatatattctattttttcctcctagcaattttgataataccaattctgagcatttgaaagttggtaaaagggaagaaggaaaaaaaaggacgcgtcacgtgaatgtgaacataattaagaaccttaatttttccctaaactgttgcagcttgtttcacattatctctgaagaaattagtctcgtttcaagatgaaacggccgtacttaagggaatatggggaatgtcgcgttcatgaattacaaacaattaaagtgaaaacttcgatggtttgaggttttgaggcgatttagtgagaaacaagaagacttaagatattacatatatatatatcatacctaaaagtgggtaaatatggataaattctcaggcaagaaggggtggacaaatttttgctctggttttattcatccagagaaccagagatagatagtgtgacaatgggcaagaggatagtatttaacataagctctgagtttcaactacagtcgcttctcggtgagggtgcttacggagtggtatgttcagcgaagcacaaacccagtggagaaatagttgctatcaaaaagatcgaaccttttgagaaacccctattttctattagaacattaagagagatcaagatattgaagcatttccaacacgaaaacataatcagcatatttgacgtgcaaaaaccatcatctttcgaacagtttaacgaggtgtacataattcaagagttgatgcagacggacttgcatagagtgatcgtgacgcaggaactaagtgaggatcatgtgcagtattttgtataccaaactttaagggcgcttaaagtgctgcatggaagtaatgtgatccatcgagatttaaaaccaagtaatttgttgttaaacagcaactgcgatttgaaaatctgtgattttggtttggcaagaattgtatctgaaagagcaacagatggcgatgcccatgttgacgctgatgacacggatgataactccccttcatcggcggctaatgacggtgacccggcaatttcgggaatgacagagtatgtggcaacccgatggtaccgagcaccggaagtaatgttaacagctgcacagtactccaagtccatggacgtatggtcatgcggatgcattcttgccgagctcttggggaaacaaccgttgttccccgggaaagattacagagatcagttgatcctgatatttcagactttagggacacccacggaacaagaattggtggagctagtagaaaatagacgtgcacgtgagtacattcgctcgttacctaagcatcccaagatcaattggcggcgtaggttcccgaatgcatctgcagccgctcttgatctccttgaccggatgctgcaattcgatccgaggctacggatcactgccacggaagcgctatcacatccatacttggtctcgtaccatgacccggacgacgagcccgaaggaactccgattccttcgtcattctttcaatttgaccaatggaagtcgcggctaaatacaaaggatttgaagcggctgttatggaacgaaatcgtgtcatgagacacaccatccaaaaacaaacgaatgactaagtaaccactagcgtattatatcattttcttgtgtagaggtctccaaaatgaacaaagaacaccatcagataaacataatgcggttttgtgctttggaaaggaaaaaaagaaattgagacgaaaagatcccatttcggagccgccgttctgcgattatcttaaatgcgattttttcttgtttgttttaggggccccctcgttgcagggaaggtcaaaccaagaaaaacaaattacacgcactaggaaatctgtgaacgaaaatgcaaaaaatccattgatccggactttaacacgcatgactctttccttcactatggtatgctcttcagtcatacattgccacatgcagtaattcttacgacccgatacgattccttcccctctctatccttgcaaacttagtaaactgagtaagctgcaccattaatgtttcgggatgtccgagctattgtgtgattcgagtagcgcacagcagttagacgcgattttttttttctaacgcgctgcattacttcgcttagtatatccagccattttttgttgttttggtttttagttttcgctttgattaacaacggttaaactccagttagtagcagacagaaatcaacttgtgttcttgcgtttttttgtcctattattttaattttataagacattatggtgaacaattaatgtacaactggcatatgataaaactcggggtgcaaacgtgacacatacgtacacccccaaatcggcggggaaagtcactgggtaagccaatgtatgaaaaaaacaggcgagtatttttgttttttgttctgtatttttagcttaatttcgagcgctcttattctacgtgtatttctgcgttttttgagtctccagagttatgtcgtcgtacaaaattcgtgcgttttttcatttttcgttttacagaactgaaatcatccgcattaaaaccaatgaaaagcgatttttcaacgagattttctatataagccagagagatttggttcaatatcgatatataggaaaaattgaaattatgccacccctatgtattacatgtaagcttgaagaataaatattatatatatacatatactccacattcaatttatatcaaggttcagacacaattgaaattttctttgatagacagagggaagaaaggtggataggtcattttttgtatcgcttctctgatcttaatatatattagtgtaaaatacaaaaaagaaaaataaattaagggaaaatagcccatataacataccattaaaggaattaaaaatgacagtttccagattgttgaaagatagagttagatatgctccatatttgaagaaagttaagccagtagaagagctgattccattgtttaaggatggtcaatacattggttggtctggtttcaccggtgtcggtgctccaaaagctgttccagaagctttgatcaaacatgttgaggaaaataacttgcaaggtaagcttagattcaaccttttcgtcggtgcttctgctggtccagaagaatgtaaatgggccgaacatgatatgatcttgagaagagcccctcatcaagtcggtaagccaatcgccaaggctattaacgatggtagaatccaatttttcgacaagcatttgtccatgtttccacaagatttgacctacggttactatagcaggaacagaaccgatggtaagatcttggattacaccatcattgaagcaactgccattaaagaagatgggtctattgttccaggtccttctgtcggtggttctccagaatttatttctgtttctgataaaattattatcgaagttaacactgctactccatcgttcgaaggtctacacgatattgatatgcctgttaacccaccattcagacaaccatacccatacaccgctgtggaccaaaagaacggtcttgattctatcccagtggaccctgaacgtgttgttgctgtggttgaatctactcaaagggatgtcgttggtccaaacactccatctgatgctacatctcaatccatcgctcgtcacttggtcgagttcttcgaaaatgaagtgagacatggtagactacctgaaaacttgcatccattgcaatccggtatcggtaacatcgctaacgccgtgattgaaggtttgactgactcctccttcaagaacttgactgtgtggactgaagtcttgcaagattcattcttggatttgttcgaaaacggtgccttggattacgccactgctacctctatcagattgaccgaagctggtttccaaaagtttttcgataactgggatgatttctcaaagaagctatgtttaagatcccaagttgtttctaacaacccagaattgatccgtcgtctaggtgttatcgctatgaacacccctgtcgaagttgacatttacgcacacgctaactccaccaacgtctctggttctcgtatgttgaacggtttgggtggttctgctgatttcttgagaaacgctaagttgtctatcatgcacgctccagctgcaagacctacaaagactgacccaactggtatctctaccattgtcccaatggcttctcatgtcgatcaaactgaacacgatttggatgtcttagtcaccgatcaaggtttggctgacttaagaggtctatctccaagagaaagagcaagagaaatcattaagaactgtgctcatccagattaccaaccaatcttaactgactacttggacagatcagaacattatgccaagttgcacaagtgcatgcacgaacctcacatgttaaagaatgcattcaaattccacttgaacttgtctgaaaagggtaccatgaaagtcgataactgggattaagcttgtttatctcgctagacaggtatgataagatgaaaacttgttggcatgacattcattgtccgcaatatgtcctttttttttttctctttaaaagccatgcttcaagaaactgctattttgatgacccccaaaaacttattacacaataacatatagttcgtttcgtcttgagtacacatttttgccaacgaaactgaatttgacatgatatattcgaagaacaaacaccatacagaagcctacatatgtatttctatattatctacatagacgaactatcttatggaacgaagaaatatgatttttatgataattttctggttgacctcccttataagaattcattggagttcatcttaccacatcttttattaagcctatttacaaaagttgggactggttccagtgcaaacccttcgaattgcaaaacattggtaccaatttgaccatcaatacattggatgatcatagtcttctcgtcctcacttaatttaaattctccaggtttcattgatatggtttcattcaaatcaaataattcggggaatataatacgtttcttcataacttctttcttcctctttggtaatgataatttatagcagtacaacgaccctaaggcatcattcttggccaataaccgtaacttcctttcgtttttccaatttatttgtttcatttcagtagttattttgggagcaagtgaaggttcatagtttgggttcggttttggtttgaaatccctttcccttatcatctgttgcaacaattcaccacttttcaatcccaattgatccataagtgttgcaaccttctcggggacatcctcgtcaaatttaccgacggtgccaagcttcaaaatttcttgcactgacaacggagccgtctgtttgatgatttctccatggtcgaatttcgttggatgtaaactctgaatcgtcacacctgtaaactcatctctgttcaaaagtgtatactggatcggggaggagcctcggtaacgcggtaacaaagatgggtggatattgaaagcttttccgtcgaccttttcaattagctgtttgggtattaacttaccaaagcttacggctatcagtacattaaactcaaccgaaggattgtcgattaatcccaacaaatcagaccttgtatcacatttaatcaccggtggtaaccccaaagaatcatttaccgacataatcggaacctcccgcacttcagataagtatctgccacatgattttggcgatctggtgacaacttgtagcgaatcaatgtccttggttcgcaaaagtgagtgcaatgcactaagtaaatgagacgaatattgatctgaaccaaagaaaagcactttcaaagggttcccattactagtagaataaaaccttatgacacatgtgcttagtgtcttgccatgtttgaaaccccacatgaccgttgtacagtggggatggcattttgcaacaattaagctgagctagacttatttctgttggtgagagagaggttttcaattgaaattcactttctgttaatcatgttggaacatgagaagttgacaacaaaaggcatgaagtgagagagacctcaattcacttcctatattattcactcggtagggaatacactgtaaatatgaatgacgatgaaaaggcaagaattgctagaagaaaggccaagttttccgaacaacgacgtcaagagttgttagacgatccattgaaggataaaagcttgctcagccggtctacagcggataacgaaacaacagttatgatgagattgaagactaaccagaccgtaagagaccaaatgtttgttcagattcaagagctagctcgttctgggaactccgatgatgaagtgatagaacatggattgcgtaaattaagggaaatcatcgtaagtatctaccacagcgaaaaacgtaatgatgaattcatgaattcggttaaaaatgtctacatatattctattgagttttacctcgggagacgcccagtgaactggactaaactcgtaaatattctcgaggcattcgtacggaaagtctccggagtattagaatgtaaagaacatggttccgcacttgtgctatacgaagctatcgaacagcagcaatacggtagaagtttacaaataatacaaggccatgagaaacagatatgggacccggtactatgccgattgatcgtaaaatcatgcgctacagacaacttccatctatggttctacgcattatcgaaactagatgataaaacattcctatacaagttcctcatcacactcccctatcatgaacaggcagttcacaccgtgttaaacataatctcacgctcttatcatcaactgaccttggcccacatcacggaattctggttccaatcggtaccaattgcccatcttaaagatgtgatctcatcacgatggactgtcaatgaattaaaccatggcagcatcgtcaaattcaggaaataaactggaattaaaacccactgaaaactcgatgtacatagctatacctcctctagatatatactcatgcatataagatgccaccggacaaccatagtatcatctatctaacggtaccactattaagcagccgttccatttcattgtctttgtcaacgaaaatccttttcatgatgaaaatgcgctttaaatcaccgaactaacacaacttattacaatggcacacagttaaatcaacaacagaacaccgttcgtttgactagtgtagcagttgcaggtggtattgatcaagtcgggcacagtactgatattggtgtttttaatctggttttttgtagagctggaagaggttaaaatttagtttcaagactaggtgaattcaaagatggctgtcggaccaccagatcaaatctttaaggacaatttaacgttcgatacgttcagagaattgattattgagaaagaatctactgcagatgaggttgcagataaagtcctggaggcgaagaaggcattactgccgatacggacgttgatgactgaatttgtgggtatgatagcgaatttagaaagtatggggaacaagacttcgcaggagaagtttcttgccatacgaatgaagttgattgagttacagaataatatacagaagttttccaaggatttccagcaacttcagcccgtgatgaggaccatggacaagttcaacgaggaagttaatgcgggggagaagaagttctttgttcaagagactttgggatacacacaactcgccagtaacggaagtgcagccggtatcactaagactagcagtgggaatgatggcaacacaactggttctaccgcaaatacaatggctatggcgaaaggtctgaagaaaaatgctgctggcaagcccaatactggtaccggcgtacaatccggtcctggccgcagaaactcgaccaaaaaaaccggccatacgggaccagcaacagcaccaacaacatccaactctgctgcttccgctgctgctgcagctgcaaacactccaagtttgaaacagatcccaaatacacagccaatgcaattgatgcctggtgtatcacccatggcaatggcaagtccactcaataacatctccccacaaaggaagctcactcaacacgttaatcaaagtagagaaaacagtctacatcaaggggtaactccttcagcatcgatgatcactcctcaaaatatcttaaacatgtcagcatttgatcttaaccaaaaccaaacaccacagtctttggataatgtcaataatatggatcttacgaacctcgatttagactctttgaacatggagttcctcaactgaagcagatatatacaatttgtttgtttttgcattacctcgtttataaagctgtgtttcaatataagtttatatggcaatattacgtaatactgatccaggaaacggtgattctttatttcgagcacctcatcgtattcaagctagtttctggtttatcaaattggtatatcaaattgattataagccagtaccgcgcgcatcgtgcctgtacctctgttatccatctactattaatcttcctagccttactttgagtcatctgcacttaatttcgttgtgaaaaaaaaatcgattcgaaaagaagtactcttcacatatatatcgcacatacactcatttacagaagagaaatgcaatccattagcgtgatttaagtttgttctatcattcttttaccacttatcaaatctcaagctcaacattgatctaaagaaacatgtctgtgttgttgagacaagcgtttgaaaacgctaagaaagaaggccgcaatgcccttgtcacttttatgactgctggatatccaaccctagaggataccattcaaatcatgaagggtttccaagacggtggtgttgatgttattgagttaggcttaccattttctgatccagttgctgatggtccagtgattcaaattgccaatactgttgcattgaagaacggtatcgatatgccaaaagttttggctctagttaagcaagcaagagaagaaggtatcaccgtaccaattgtattgatgggttactataatcctatcttaaactacggtgaagagaaattcattaaggatgctggtgctgctggtgtcaatggtttccttatcgttgatttaccaccagaagaagctttgaaagttagaaactacgtcggtgaaaacggattgagtttaatcccattagtggctccttctacaacagatgaaagattgagtctactgtcccatctcgctgattcattcatctatgttgtctccaggatgggtaccactggtgccagagaatcagtcgctaacgatttaagtgctcttgtccaaaaagttagatcattctctggtgatattccattggctgttgggttcggtatctctaccaaggagcattttgatgtcgttggatctgtttccgatggtgttgtcattggttccaagatcgttactttgatcggtgaggctgctcaagataaacgttatgaaactgcaaagaattacgctgaagaaatctctggtggtaagaaggggaaggttctttctaaagaagagttctggaacattcacaaggccaatgttgcaactgctaaggaaaataaaacagttgccaaagagttcgaagaattccacaagttcccggctcgtttcggagagtttggtggacaatacgttccagaagctctacatgcttgtctaagacaattggaaagaggcttcgaagatgccgtcgctgatccagcattctgggaagaattcaagagtttatacagctatattggtcgtccttcctccttccacaaggctgacagattgactgaatactgtggcggtgctcaaatctggttaaagagagaagatttgaaccacactggttcgcacaagattaacaatgccttggctcaagttttaattgccaagagactgggtaagaaaaaggtcattgctgaaactggtgccggccaacacggtgtggcaactgctaccgcatgtgccaagtttggtctagaatgtacagtcttcatgggtgctgaagatactcgtcgtcaagctttgaacgttttcagaatgagaatattaggtgctaaagtcgttcctgtcactaacggtactcaaactctaagagatgccacttctgaagctttccgttactgggtctctaatttggaatctactcattacattgttggttctgctatcggtccacatccatacccaacgttggtcagaactttccaaagtgtcatcggtaatgaaacaaagcaacaatttgctgcattgaacgacggcaagctaccagacgccatagttgcctgtgttggtggaggttccaactccactggtatgttctctcctttcgagcacgatgcctcggttagacttatcggtgtggaagctggtggtgacggtattgataccgatcatcattctgcaactttgaccgtcggtagacctggtgttctacatggtgtaaagacttacgtcttgcaagactccgatggacaagtgcatgatacccattctgtatccgctggtttggattacccaggtgttggtcctgaacttgctgcctggaaggcttctggtcgtgctgacttcatggctgctactgatgctgaagctctcgaagggtttagacttttatcgcaacttgaaggtatcattccagctctagaatcatctcacgctgtctatggtgctgttcaaatcgccaaaaccatgaaaaaagatcaacatttgattatcaacatctccggtagaggtgataaggatgttcaaagcgttgctgaaattttaccaagattaggccctcaaattggctgggatctaagattcgaaaaggaccctactgcaggaaactaggtttgaagttgatgccacaaatggaaaccctgtgttagaatatctatagacactgaattgtacattcacattgttcatttatatatgtaaaaactccaattaacgctactttgtatcaaataagcgtttccctgatatatatcacacttaaaacatgcttcgtgggggtacgctataatctaaaatcctgaactacggttctgaaaggctccagccgcattatcgccatttccttagtgagtttttgacatatttcatcacatactttaataagaaaatctcagcattcagaaatatagtgtaccacatcaacacaagaagatggatgaagtaaaccagacattcaaaacgtgggctgtaaccatctactatataacaagttggtaagctcgctccgtcatatatgtctttgcagcccaggcataatgagaggggccatcaactgggaataggtgtggtagcatctagtacatatgtgccattcaatgaatcaaataatatagagaatgacaatgagcattgggctctctcttcactcaagaaaagagatagaatgtactttagggatatgcgtgtattacaggagggaaattccagggaatcacatacgagtgatttgggtatttataataccgacatggaagaagttccgtatcctgtggaaagacaaggcttttgcaaccaagtactgcgcaaactggacaaaggagatatattgaaggatgtcgaactgcgacctaatgaggagcttatttccttggacaatactgctatcactagtaaattttatgttcctagcagtttagtttctaagatagcaaaaggtgagatgtcgatgacaagcgatgacggacatcgcaagcaaaatagggccataagagtgtcttcgtcacatactagaaaggatttcaaggttatagaccctaccaggaagcgccaaattgcagtcgcagaacttcttcctacagttgatgcaaggctagataaagaacctacgatgctattgataaccataaaaggtcccacggaatcagacctctctatccagacactagcattagataaaagaacaggcctatacgaagctaattctgagccaagagtaataagtttacaatcaaggataaagcatattgagatacccaccttatctaaatctctagcaaggtatccgaatttgtttgcagttatcactaatagcaaaatccacgtgataagactggatagaattcacaataacgctatcgacttgactgaatttacacctttggaatttcacgagttggaacagttccccatagttcatgtggcgtttaacccatggaatctcatggagatcgcgttgatcgactctaaaggtaattggtgcatcgcgaagcttgaatcacacaaacgaaagccttgtattataaaactacgtagggatgcatctggatctatctttgatcccacagagacctcgccatggaaccatattgagtgggcagatgaccatacatccttacttgttctgaacagatcgaaacttacaatgattaatttcgagcagaattggcaacatgatatcatacaagcaaagacgtggtcagaattaagagattataaacggatctctgaacgactcagtctcttgctgacttcaaaagaaattattcttataaaaatccaagatcagcagataaacagattgctttcttggaaacatgattgggattctcgggacccttcaattcgcatttcatacaagatatctgaagacgatcaatttggacaattgatacacgtactactcttctcaaaactcactttgaaagtatatggtataatgttcggatacaaagcaaactcctgggctgttgttgtttctaaaccatttttactatcgttaggtgacattaaaagtaaggacggattgaacagcattgagtttccagataccagtaattacactaatgatttagatgatggtggcgatcgcggggtttccacagatcttgtttgcatcactgggttcattggatcggataccgtgatacaaggatttttatccacaacagactcaggaaaccatatccggctaaacctagagtatccatcatgggattatagaggtgactttttggataaaatatccaaaatttttacagagagtttaccagttgcgccaataagtcaccaagcagataatgagtaccaaatgttccaagagtatgggtataatttgtcagaaaagctgaatgagctactggattcatggaaaaacagatcagataagtatgaccttaacattgaatctctagcatctctaaaaacttttccatcttacttcaagaattttacagaatttgcctccttaattgaacaattaataacctactacaaagatcataatcttgctttttctgacctaccgtttacgacaaaacagttgataggcgagggattaacttcatgggaaggcctatttaatcgtttggtgatagcgtgggacagtatatctccaaatgcagaagagcttagtagatcagctacccaagacatgactttatccttaactgtatgccaagatcaggaaggaataaagaattctttagaaaccatcaccaatgaaatttctgacaatactaaagctgtcctggatttatgggacaatggatctgatgaaacattaagtaatatgcaatcgacacggccgcctctattttctgcatcagtatcctcccaacagtttcaggttcccacgataaaatcctcgcagcaaacgtccaggaagaaaaagcttccttcatcaacctcgaggggacttcacagtttatcagtatcacaaccaactcagttcatgtccggcaatgggttgcccgggaacatggcgcctgcattttcattgggtgctagtaccaggtcaactcaaccgatgcccacactttcacaacctgaaggtcagcaacgagtaaagaagaagaaaaagaagaaagtcggaggtttcacttaatgtatatatttttgtccatcgaatgattatatgtaatatttaatttgataccatttctcattttcttctatgtttgcaaatatagtaggttgaactaagattgatattttactctttaaagtgaactttgaaatttaaaagagtaagttgtattaactctggaaacagtctgcgaagaacaaaagtcgtcaagatttgcttttgagaagtccatcacttcccattctacacgattgatcaagccatctaaatctcctatggtgcgctgtgcaagcaatctttcattctgaatacttttgtcttttattatattcaaagaagaattacgtatttaaacttcctaaagttgagatacttacagccacagatcaattgcactgccaagtacaataaaatccactgacaaaaactttcagacggctattcataagataacatttgctactaaaaaaagccacaaatgattactctgtccaggctgcttttgtttgcggcccttaatgctattttaggccatagtatagcattagatctggatgattatagcaaggcaaataatcaatcgcttttatgggccccttatagatcaaactgttacttcggtttaaggcctcggtatgttaatgatgagccgtttgtcttgggtgctatgtggtttaatagcatcaatgcacaaggtttggcaaaagttcggcattttgttgagcaaggtgacaagttagataaatacggatggatctggtatgatccgagaattggtggcagagagaccatcagagattctgaaagtaaccttcagctcaacttcacgtttgtgaaatcgcacagtggcgagaattgggctgttcaagttgaaggtgatttgattgacaaaaacaaagaagctgcacattcgatcgttatttatatgaagcaaaacggcaaagaagactcttcctgttacttaaaccagaatgacatttttacaaaaaatcgtaatgagctctcatttacaggattctcaaacgaattaaagggttacactatcaaacttgcagacgaaaacagcaagttttataaagatgcagttccacctttaagcccagactgcgatccttcgaagccgactgttctctccatgaatataccagatgatcaactatggaaagcaaaagacgtgtttcaaagtttattgaaagactcgattcaggctcatgtcgaaacaaatccacaattgagcgctaatttaattccaagtgcgctaacgatccgtaacatccacaattttcctccaggaaatgtgcagtatattcaacaaacctttgaagggcacttcaagttcaatattatattcaacaaaaagggatcaaaagaccaaattgcagaaaactcagttgatcaccttattgtattggcggaaggtttggtgcaacagaagttcaacaagaaatttggcattgcagacaattccttatatagagattttgctcaggaaaccttttcaaatctattaggtggtctatcatatttccatggtactcatctagttgacagagaaacagcattcgataacgaaaactttgatagaatagaattgctgaattcgaatgaagagggccctttagagctcttctctatggtacccagccgcgcatttttccctagaggattctactgggatgaaggattccacctattacaattattggattacgattctgatctcgttttcgaagttttacacagttggttcaatttgatagacaaagatggatggattcctcgtgaagttatcttgggtgacgaagcccgaagtaaagttcccgaagagttcagagttcaaaatccaaatattgcgaatccaccaacgttgctacttgcattcagtgagattttgagccgcgcaaagaccatacaagaggaaatgttagaatcccatctccaggaaaattatcaatatgaggaactagactcgtcgttccaaggcgacaaattgaataacaatccagaacttttaatatcctatgccaaagaaatatatccaaagcttctaaagcattatgagtggtttagaaactcacaaaaggggatgctcgaagagtatatggaggttccttccataaactccaaagttcacatggaagaagcctacagatggattggtcgcactttcacacattgtctaccaagtggtatggatgactatcctcgtgctatcccaccggatattgcagaactacatgttgatgctcttacatgggtgggcgtcatgacgaggtcgatgaaacagattgctagtgttatagatctcgtggaagagattaaacgatttgctactattgaagaaaatattgttgaaaaccttaagacattgcactgggatgacgaccaaaaattgttctgcgacataacattcaatgacgacgctaataccgatgaggctttaagaaagttcgtatgtcatgaaggatacgtatcgctcctaccattcgctgtcaaattgataccgcatactgatgttgaacgcctaaaacatattctagattcaatgagcaataccacaacccttctatcgccttacggaattcgctcgctatccaaaacagacgaatattacgatacaggagaagtgtattggagaggaccaatctggttgaacataaactatctctgtcttgacgcattggaatactacttcttggaatcaccactgaaaaaatcagaaggtcaaaacgaagaactcttcttacaagctagaactctgtacaaacaattgaggcaaaacattatcgataacgtgtacaaaatctggaagaaagatggttacgtttatgaacagtacaatcacaagaacggtaaagggtcaggtgttcaacattttactggctggacagcactagttgttaatatgatcggaaaattaccagaagaattgtgaatgcttgtcacagtcccaagtttgcgaaatgaacacgattaaatctaaatagattacactagaaatggagctaatgtaaacataccgtttgccgacattccatcacagccagcagcaaggttattaggaaagaagctacttttgaaattaccatgtgttatatttgttggccgattgacctaaagttcagccgttggggaatgtaacaacatcaggacctgctgccacaggattttatagtttaggctatctattttctgtattgtttacatttttggatcataacccagcatttccaaaccagcattttagagccagcatgagagaatttaaagggtttacgtatatagtgataaatattaggtcgccggaatctagttttccgcagtctatcgtggcgtcatcaggaacagaccaggggtgggtttaggtttaagctttttcaggaacaattcaggaaccagtcgatgatgtatggtttctctttttcccggatttctttctttcttttcctttttttttacactctctccgttgttgtgctttagcattgttcgtactttgccattgatggttcattgttgccattgatggttcattgttgccattggagaggttggagaagccgtgattgtacagaaatcagactatcgtggtagcaaatgaagttgtgagtaggtcttttttgttattccagcacaacattcttgttcagtgtttacatgaacatgggtagtttacatagatggtgtgcgtgaatggtttgttatggatggtttattatgaatcgaccacctggatcagatcaattcgaatatctagctagatcaaaacaagcttaatgtaaacaacaaatcaacggtaagactcgcgacaaatgcttgcatgagctgcgtaaaagtgtcaaggtagttcgataaaatgggatatataaacggagtgtccaaaatacaagttctggagattcgatttagaacaagattcactgctttaggttatgaagagtttgctaacctctattctatatttatctattcccctaagaaaatcatcaatctgataactaacgaacaattcacctgttttaagatcattacatttcgttgtaaaaatgactgaactaaaattccaaatacgttcgcttctagttctagcaacgctcctcacatatgttttcgcagctcctttgaaccatcttcataaaaagagagaaattgtaacgagagtacataccgcttctcaaacaaacactgtcactgacttttactctaccactacgcaaattgtcctcgcaccaactgtggaattcattatttctggctcagtcacaataacaactactctaccactggctgatggatctgtaccaactgaatccccaagtgtaaccataacatctgtcttcaatgaccgtggagctgcagctgttgctgttccaacacatcctgctgcggtagcaggggaagcagatcctaaagtgagtaccattgtaaacgacggtacatctacattggcaccaataactgcatcaactcaatcacagaataacgataacggtgctgcttccgcaacaaccacaacatcaggggttagtgttaccagtggtagtgacaataacaacaatgacaacaccagcaattcaggcagcagtaatgaaagcagcgacaacgataacaatggtaatacaagtagtagcactgagaatggaaacgccggtaatgcagacactagttccagcaccagctcaagtactagctcaagtaccagcacaaccaaagacagcagcacaagcacgagttctggtagcaccacaacagctggttctggtaccggtgttccaaatactattgtttattccccatacaatgatgactcttcgtgtaagagcgctgattcagtttattccgatctgcaaaccattaaagcaaagggtatctacaaaatcagaatatatggtaccgactgtaattcattacaaactgtacaaccagctgccgtcaagttgggtatgactatcaaccaaggtttctggattggttcttctggtgttagctcaatcgacactgctgtctcagatgtgatttcctatggtcaatctaatggctgggatgtatttgacttcattacaattggtaacgaagctataatttctggttactgttcagtggaagacttaattggtaaaatctcctctgtcaaggcacaattgaaatctgctggctacggaggactagttactacctctgaacctcctgtaatctttgaaacctacccatctttatgcacaagctctgaaattgatttcgtcggtattaattcccatgcctatttcgatccaaactcccaagcatctactgctggatccttcgttaagaatcaactgcaaattgtgaaagatgtttgcggaacagacaatgttagagtgacagaaactggttacccaagtaagggtgtccaaaatggtggtaatattccaagtaaagctaaccaaataatagctgttaatggtatcttagaggagttgaacggagatgtcacaattttatctacgttcaatgactactggaaggaccctggtacttacggtgtcgaacaatctttcggtgttattgatttcctatcatgaaacataccatcctagcataacattaacgtaacgaaaccgccaacagcggaaaataatagagtaaggaaatgattaggatctgaagtataaacaaaaaaatcacgcacggaagactcattactcttttgaccgaaaatagcttccttcacaacacgaactttcctagttggttttatcgtccatcattaatctcctataaacaatcgtaatatttctatacctgaatgctgattataaagcagaatttgtaacacataatatagcacattaaatgttctccgttttttatctaggtaagttatcttgtctcgagtccgttattagaattcaaccagtttttgaggaaagaactcatcgatcaattcaaggtaatacggttttaattcatcgcggttatgtttttgtaatcccttggaatagagatcatattgattaaaatcctgtacagcttccaagatttcataatcgctttctgacatcaaatatcgatatgcgccttctcgatgccatggatagaaggaatgatatctaatcatagccaaagccttctcattcagagttgattgattctttgcgatataatacatatattcatcatgcccccacgaaatcatcaccgattttaggccactgttttcttcatatattcctagtttagttgaatatattggatgcgaattatcgggattaccttgaaagaactcaggaaagatgttttccttcacgaaaccacaaccaatggggaaagtgtctccgacaacatcccactgcccttcactctcaaagaagtataggatcttacctaaatcatgtattaacccaacgagctgcatccatctaggtttaccgtcatttcttatcgcttcagccgtttgtaatgcgtgatctatttgggagagttctgtgtctgggtccgattcatctatgagtttacttaattggcataaagcatcccaaacagtcattctggctcgcactttagtcttgaaattaattcttgcctgtaaattgtacgccatcgtctgtttctcatgctgttctttgtagaattctcgcactctatctttagcctggttatattgcctgaaatcttcctcatttattccatctaggacactagtcgaatcgttcattttcctctttttagacggtacggggtccttggattgctctcgaagcttggttttaattacgttgattgactgaacatcctcatctataagctccagtaaatggcctttatccgaatggataatctctcccaaatcctttgacattgtttcaattatttcaacggcactgagcaaaagatcccttttaacagagcactaataaattcaccgttcgaaatatcagagcgtaccgagacgtatctcatacactataaacttaatcctgttctatcgttaagttgacactcacatccatcattagaaaatcattgagaaatatccataacagtaattttagtgcaaggtgagcgaaagaaaactggttcttgtaattaatttggctgctttagctcagttgggagagcgtatgactgaagttcataaggtcctgtgttcgatccacagaagcagcaaattggttttaatttttgtcaatttcccacatactttttcatcgtcagtatatacaattgcggaggacggaacaagcctaaatcgttaatgcagatatgtctttattctattatacagtatttatgactttatgtctcaacgctctttcaaagccttatttctcttttctcttcttcttagtctatcgaccttcttagcgtgcatcttggcagccaatctatcgtacctttcttgttcttccttctttgctcttctttccttcaaagcttgaataacagcgtctttctcggctttcttctcctccttcaaagcacgtaccttttccttgaactgctgatcttctagtctcttttgtttcttcaattcccatgaggtcaacttcttattcttcacgactctgttcttagccctcaaaggttctttctctaccttccaggtgcggccactaacgggcttacccttgatctgtatatcctgctgttctgctgtattgtctgacatgataattcgtacactttcgcgattactacagtaatggttactccagtcacgaccactttgttacaacctttgtatgtgtttctctcatctcatctcatctcatctcattgtctctctaatttttcactatcacataataatgaaaaagaaatctttaacattaaagattgaaaaatttctagttagaaatgagatgagatgagatgaacttaccatgaaagtattagttcaaaagttcaatcggtgttatctgtcgctagatcatcgattaattgaattatagtgtaaggaacatataaaaggtgctcttttgatcttttggaaaccactgtaagagggaatgctttcacttggaaagaatggtaagacttcgtcaacactggtacgaaatgcgcgaaggagtgtgatcatgccagctagcagagatgttagatctcgtaagagacgggcgagatctgtcactgatacgaaagatgtgttagatttggattcaatcgatttcactaatgagaaggaagttcagttcaaggttaatcagttgaaagagttcaccagaaatcttcgagaacagatcaagtacactgatgagctaaagcgtaagcatgttatagaagaggaggagacaaaatcggtagatcccgagatgcatgattttgacagcgatgctggagttattttaagttcattgaacgataaggtagcgggccctggggcagaacagaatctttcaactcttttgttatcagataaagctgatacatcgttactacccgagcgattatcagagaggataaaggacaaggacctcattttgaggtgtttgtttgataagaggaatagggattttaatccgatagtaacagaactataccattcagaacagagactaaagggtttaggaatccaatttatttattccaagattctttcgaaattcgataaactttcctttacgagcttatcccaattggatgagatgataatggaaagcgttgggaatgactcctcgcggttaaatggtaacttatacgagcatctcatgttgtctttttctcgggttacatcaccatcagcacagggcaaattggaagtatgtggtaaacttcgagagttaacagagagaatggatgctacattatcgaagaaaagtttccagccaacacagtatatgctaaatgcttgtatatttgcagcttcaaaagccatgagctgggagtatatggacttttttttaaagaaattcacctcgacgtatgatatgcaacctaacagaaagaactatacgacagtcatttctttctataccaagatggaacactataagaaagcttggcaactctttgactctcttaaatttttgtccctagaacacaaaccagatactaaggtctacaacttgatgctcgaagtgtgtcaaaaggagaagaattacgcaagatcattagatattttccaagaaatggacgatttgaacgtcacaaaggacctaaagacttatcttaacgcagctaaatccttagcattgtcaagtgctgacaacgtaacaagtgaaggtaaagcagattcattaaggttaatgagttggaagtacatccataagattcatgatgatcctaaattatccaaacagctaaccgaaaatccacgcaacaacatgctgctgctagagacaatgatggttttatcagcttatgatggtgacgtcggatttgctcgtgcgttgtactataaatatacgaacgcattgttcaaagcacacttctatgaattcaaaaagtatcacaaagataccgatccagttgattatattcgcatttggaagaaatctctttccgcacaaatgtttaactggctaatgttatcgtactctaaattcaaaaagtctcgactaccagtattattaggatatccagaaggttcaagcttgagacgtagcatgatttattcagttgactattcgggacgagattcctcctatgagaattcaaatattcaattacctatgcttcctatgactgagcttaatgatgcagaattaactataaatgaatcaaaagccttatggagatttaatttagagtttggcggaaattatgacattagagaattaccagaaggtatgcagacagtgaaagatatagagaatattgtcaaatgtgcaaaaactgttaatgaattcaagctgcagatttcgcagcgtttattggaatggaaaaacagatatgtcaatcacaagattctcaatatgaaatctttgataactttcctcacgatacctattaggcttcatgaacccaatgagttcaaattgaggttacaggaattcacattccaagcgttcgaattcaacgaaagggtggaatatcaattcaaaaaatcaaaaacgaacgaactggaatcacctgtactctcaaaagattttaacacaaccgacagcaatgccttggttgataacggtattataccctcagaattccttctatacttggtttctatgaaacacaaactagccactaattgtgctatctacgaagtgtcgatgaaagcagccatagcgttccatgattacgaacttgctatgacaacatggaagaacagaggtaaattcagaatgactgacgctttccagaaattaacaccaggtgaaagacaacaaagtgacgcaactttcgctcaactaatggtcgaatacttcacgaatgaaaagatgtatcaagacgcattgagtatcattttgtcatctttaaagacggtaaactggcagtattctatggttaagtccctacacagagcgttgctagctattgaagatgagaactccgctgcaagacttctgagtgtggtgaatcggaaatcaaagatagttgaattggaggaagagatcaagtcattagacctttgatattatgacatcacgaaagaatggatgctatgaaaataatgagaattacagtaatgataacagctcacaaccaagaaacctgtaaataaattgtagtgtttattatcatttaaaaattctcttgtaaatatttaatagatagattaaggaaacgacattaatatattggtgaatctaacctttgatattaggtggttggaattttcatctcccatgttaactcatcgctttgattcgaagcaatactggcggaatccgattcatccagtgctactgaggagctagagcctttattgctcaattgtttctccaacgtttctacttgaattctcaatttgtcaacctctttctcaaacttcttaccgtaataatcgacataataactagcaccgttctttgccgcatgaaggaagatgaatatcaggaagccagcagctgcaatactattgttgagccatatcacacaaaggatcatagtcaccaactggtaacagtattggaataatgtgtaaagtatcatcggttgtggtggtggtaacttaacaacccatgagttcttatactgatgagaggtcaaatactcgaaactagtcattcgctgccctgatttgatcttttgcttctttctcaaagtgataaagtaatggtacaacgattgccatattagatagtaaatcgaagtgtagaacacattagtcttcaaattccaagatttggaatttttcattgcagcagctgggaatctttgcaatttgaattgttcagtgattgcatgcgttatgcaatacaatgtcaatggaggcatgatatggatgaaacaggatgtgattttatccaccgaatgaatgacaagagagttccgccacgtgattatggcgaaggacaaagtaccaaaagtgaaggcaaaacatgactggtacaaatgtgtagatgatggcagtacccaaataaataacaagcacatcgcattaacgaaataacataaatctgccaggaagtaatgattattcgtcttgtagtaagtgtaaaatcgcaccggcatcaacaaacatagcatagcagtgtagtaaatgtggaaatattgagggtacctaccgatgaggaacccgatcaggaatatattgaacaaagtgaatggataaaacgatttttcaagtgttgagctattttgaaagaaaattgattgtaagggcttatcaatagtttttaacttcttcaacgtcttctgcttgaaattggccaactgaggcgaaatttcctgatctctaaactggagcttctgtttaccattggttaatttctgtttgatgaattgtttcgagggctggctgtaggattggacagtcgatgcgatagggtccaaaaactcaatgaacgtggccaaccgagttctaaaagactgttggtcagtcatcgcgatgcctttcggttaagcaaccagtttccttagcaaatagtgtatcgagatatgggtctgcacctgagataaccaagtgctttcccctttgtccctttgaggtccttattcggttcgtatatattgttgtttatatacctaggctttggaacaatttcacatgctcaaagcagtcacgtgaataagaagtagtttcaagtaactgttgcatatccgatctgcatggaagcttttaagctcagaagtgaaacttgacctgtataatactcatattctattataatgaaataacggcgagtaaatatggttacatattatacaaaatgaaaacagttgttataaataggaaagaaacattctaagatagactagagagttttctatcctgtttaagccaaagcagtcaagatatcggagtcaccggcatccaaaatggtaacgacaccgactctgaacaacttaccgacagcggtacccaattcgttgttaccaccttggaagtagtagaccttggtcttggacaacatggcgtagtattccaattcagactttctcaagactggggtgttggcagcgatgatgatcaacttagccttaccttgtctcaaagacttgacggtagacttgtaacccaaagagtacttaccggacttaacgactaaagccaacttttggttgatgttttcttggttcttagctggggcctgaacaaatagaagaagcaattatatgcgagggttttcccacataataaaagtttgaaaaactgttagtaaaatggttccaattaagaatccaagtaatgcaaagaggccctattccgaaaacgtcaaacgccaagctttaaacgaaagtgaagtcatttcttctaccgtcgatgggttgcttgttttattagattcgattcgggcgactagcgcatagaacaaagtatactgaccatctctgtgtattttaactggtgatatctatctgaacactccggtctggttttttaagactataaatcaagagacgagcataaaatagtagaagacaacgtcaagatgtataacaagctttgtcttatttgtatcattgagagatgagaaactgttgaaacttttcagtaaagatgtggaaagtcttgtgtgtggtcttatcctgtcagggtaacaataggagtgtttgagactgttttcgtaacgaacagaaagtggtgtacggatgtaaactttgaatttgctttgaaaacggcgcgaattactgtattaggaaatgcatattctcacttttttccaatttcagttcttcctgagggaaggctgcctggacaggggcagttccctctgtctggctagctttccagcaaggcctcccattggatccaccctctaggatgctgggagaggattcctaggcagacagtcatacacttccctcagcagcaatcccactctgaaccagactctccagctcacgtcccacctggccacagtgctccaatggtctgctcatgcgctggactctggacaggaatggtcctgagcctaggctcagagctaggacctgttccaggcagcttggcctgtcttcgacatttctcacaatttaacaattttggaatcaacaattacagagaataacaagttaattagtgtgtacaggtccaattaagacatatatacgttttaatagaggcctttgtttagatagaccaagccaatcaagtgaaaaagtatgcaccatacgcctccatatacgactgacacaaatatagtacagaccgcgtgttgagaagagagttctgaatgaatgaacgaatggatgagaataccggaacgtttgaaagattgagtttgagagtgaggccattgccaatatgatagaataatggatagaataatgaacaggataaattaacgtgcatgattgatgtaccgtgatcgcactaattttctgaatttgcggttagaccaatattttaaatgatagccatcagaacttatgacatattttcacactgtaaagccaatacaatgaacagagaaggaagattaggaatatacaggtctttcactcataacgctgcataccagtactgtcatgttgttataccgtttgatattttccaaagcaaaagatttactaacaagttaataacgttatcgcaaatttgaattacagataagaaatgaaggtcgaaattgattccttttccggtgctaagatttacccaggtagaggtaccttgtttgtccgtggtgactccaagatcttcagattccaatcttccaagtccgcttctttgttccaccaaagaaagaacccaagaagaattgcttggactgtcttgtacagaagacaccacaagaagggtatcactgaagaagttgccagaaagagaactagaaagtccgtcaaggctcaaagagctgttgtcggtgcttctttggaattgatcaaggaaagaagatctttgaagccagaagttagaaaggcccaaagagacgaaaagaagaaggctgacaaggaaaagaagaaggctgacaaggctgcaagaaagtccgaaaaggctaagttggctgctgctcaaggttctaaggtctctaagcaacaagctaagggtgccttccaaaaggttgctgctacttcccgttaagctttaacaataaaaccaaatactgaatttaagaacactcaagaggaattaggcccttctccctactctgaagttgaataactttcatccttctcaactagttacaagttcgaagtttttgaggttggcatatgttacacattaatgatgtcttatggataacgaacttggaattttgaatcaaataaaacgtacagagtgtctgtgcagagattgatgtatatgcagttttctcgtctattactctgttcttattttttttatatctttcttagaaaactcctatatagtaacttataatttcaccattttgtatcacaattgggcccctctaggtactaccaatgtgtgactgctctcctttgcgttaaactcgctaactgcaaacaaacttttccattcgcaccagttgtttcaccgttcaactcctccgcatttttcttgagaaagttgcatgaagcatctatgtccttaccgtattaggtagtcacaatatgggaacgtaaggttaaaactgacgtcgagaacgtcgtttcattacattgtgcaagggaccagaagagtgttgaaccattatctacgagattgataattccaaatcgtataaattgtgccgctattcagatctcagttctctcaatcgaacctgcttcagaatggtatcaattctctttcatgccaagggctccgccaaactataaaaccatttagtacaccatgcactcaccaacactttacatttccctcgctattctaactctgtccattttcgtaaacacacagagtgtaagcacttacttctcaacatcctgtgaaacaattccggagccatttttagagacaactccgatctctacaagaacaagaacaatgacttccaacggagaaactttcatcggaatcactgaagtataccaatctattacatatgtttctgattgtgttaccgatgattatgacgaatacacatcaacgcttgttatctggtgattggtgtcttctcctattgcagaactacatggttttactagtttgagtcaaaaaagaaggaaaagagtgaaatattaaacggtttctcacaccactggtaattaatccaacccttctacttttgagtcgatggccgaactttgatgaggctcaaccgaaggagattccagctggtttttcaactcccataccatttatttttgtgctgatactgttacatactttaaccttcctgcccagttggtttgagtcttgtaatcatgctgatataattatttatattggtaaatattatcaatctaatattatatgcagaatatctcatgacgtgttcaatcacttcctttcttctgtctttatcactttttgttcaaactgacgctagttttcttaattacgaaggaacatcagatggaatttttcaaacatattcgtaaagactaagcgagttaataacattcttgccatctatcaaagagatagataacttccagtatatagattctttagtggtagcgagctggtatctttagtacattgattgatcgacaggtatcgttctcatttacgataaagacgaatttgtgttaaatgttcaagtttactactagaattgggcttaaaactgggccaaaatatggatttaatccaatcataagaagagcttatgcgcagaatttgaagggtaaagctactgttaaagagccaactggtttgaagaaattaataaaacagtacggatggtctgctttaggtgtttatttgggattatcgtgtattgatttaccgatttgcttccttgcagtacactctttaggggaagagacaatcaaagtttacatcaatcgagtcaagcaattagcaaactacggtaaggacgaacaagagttgcggaatgagattagagaaaagcagaaccgagaggagttggacaggcaaagtggtgctcaagacaaaagcgtgtgggagaatttcaaagaaagtactcttctgacggagattttgatcgcttatgggatccataaatccttgatatttattagggtgccaattaccgctgctataactccaagcgtggtgaaggttttgcgtaggtttgggttctcagctgataaattcaataaggggtttaagaccatggccgatggtgcaaagattagaaacaagaccggcaaacccgatgatttcattaagaatggatcagtccccaaatcggagttttcaaaaggaaagaaatggttcaacggtatgatgtgaaggatatatatgtatccgaccatcttctggtccccatcttttcaattataacgcctgcaaattcgttgctttcacatgtattctttatatatgcattgtatatagaagttagtcattttacccttgtaaataatatagtataagtagcggttttagaacgtgtctaaaaggaaaagaatatgataaaaaccaaataaatcatctatagcttggcttgattacggccaacggtgcacttgatcaacccgtttggatcaggagatgggtagaacaattcattgttgttatccaagcccttaaaccatttcaaatcgaacaagatgtaatgtttgtttggcaactcgtaactgacgtgctcaacttcaggtgccaccttcaaaatagcggtagccatattgtacattgttgcttgcacggatggagagttctctttggcgaagatgtccaatgttatatcacgagcagatgcatagtattggttgaaaatgtcatccttcttaccagcttccaaggtttccaaagaaccaagttttgctgaattccaggtcaatgaggcaaagatatctgttgacaagattctgtcagtagttggtttcaaagtggtgtattcacaaacattgtatccgtagaacattgatccggtagatttcaacacggttagatccttaatagatgtcactaaagtataactgctgctgccgttcttcttgtcatagtctaggaaacaaatcttcttttctggaccctggtgaatgaaggagtgataactctctttgttatcaacgtcatactttatccaacgatcttgaatgatcttgacggtaatacccgaaacatgagcgtatttgccagtgaaatgcaatgctaaattagcagcaaacttttcaataggccaagtatcaaattttctagcatgaactaagatggtgttcttgacagtgtcagttggaacaataggagtgttatctgcctctgtgtaagaaacttcaaagtcacccttcaataacacttggacgttacattccataacttcatgaacttttggatcagtctttgacttctttacttttaaaaacttgacattgtccttaccgtaggtggaatcagctaagtatgagtaggttgacataattttcttgtattgggttatatcgatttggttgacttggctcgatgacttattgtgtcaattgaagtgagtaatgcttagagcttagatttgaaccacttgttctggtattccaaattgcccctcttgagctcttatatataaaaacttatttggtcttatgcacagagcagcgtcctgaataacacattgatttaatcttatctttgaggtttcaataatggattacggacatgatcgctattaggggagatacagtactttttttttggatttgttcgatgcgataacaatagaaaaaggtgtagtacatgaaaaaattcggcgatgtccgttgcccttcacgccaaaaaagatacaactaagtgatgagatcaaaggcccgatattttatattgaaaaaaattatggtccaagccgtttcatactactgtaactttagcttaagtattgttcatgtgtaagtaagatcacaaccaatctcttcctgtgtggtatgatatttttttttgttagtatctatgtggttgtggtttgacggttaactcctagcttgccttgatttagtttgacacataagccagcagttgtcaatacagggaacacagaaaagaattgatggttacaattttcacggtgtactccgtagtttcctcttctatgggcagaagttaactcgagtgtatgatttcctagtttcaacatactaaaaagttgtttacatctttgggctgaatgccatgtttaacaagctgaacacatgatttccaaattctctttctcaacttgagttccttttctattagtaggcggctatcttgaagacatttaattatattattcgaggcgaaatccgtgggagagtctgtcaagtattttacgttattatccaattcttcaatcttcttatgggcttggtcaataatttcgactaattcaatgtttgagggttctgccattagtaatgccgtcttagttgaccaagcctgacgttcagcaagtactttagcgtattcttcatttaattcttgaataccttcaaaactgaagtctttactgtcacgattctcttctaactgaatttcgttacggacataaattgatattttaccgaattgtttacaattgatcttcttttcttcaactaaaacttccaaagctttaactgcatttgccttcgatactgcattgtgtaaattttggataatgtcgttgatggcaaaaggcttatagttttcatttaaataatttagaatcaaagtttcagctttaaaaacttgttagtaaacgataaaaatgttacatcgcagcatagtgtagcgtatatcacttaccatcttcacctttcacctgttttggaggcattttgactgaacataccctggtgctaggtaaatttattcctgtttatcaattaagtctttcctaaatgttgcttgtgaagtaaaaaaagttagccgccaagcacttttttttatatcaaggtagtagtaattgagaaagtgagaaactagaagacggaataaatgaaccgaagaatagcaagctaaaagtgtagcacaagaacgaatttaagtacaattgtattatttagattctataccagtaatgtgaatataagttgatgccttgatcaaacacgaacgaaaaataatggcacgaaggtatctctttgaagaacgaaaaagggaagtgcagctggttataccagattaaactagaagcggtatcacgataatacaagccaaggtgagaacgagagtagaagaagatgggacatacttggaagaagaggcctcatttgcaaaagcattttgaatccaagcgtttgcgattgtcgttgtgatagttttagtttcaacaatatcagtgtacaaagtattaactggaaaatctgtcacggatgttgtagtagcatatagaggcgattgtttcacggaaacggtttcataagcatcatgagatatctctttgaattcagtttgatatggtacgttagaagtgaccgtgttaccaagaatcacttcagtggattggctagtgtgaacaattgtttcgacccttgaatcatcccaagtatgaacaactgtgttctcagaatagacagtttctacgggtttagcatcgaaccaagaacgaacaccgctgctgccgtacggaatcaattctgtcgagataatattttcagttgaaactgtcaccactgattcaatctgttgtataactgtagttacatcgacaaattgagtttgttcggtttccgtaacagtttcataactgacaggtaatccaacagtttccactgtaacgaatgcgttacaagctagttgtgtacatcctatcgtgattgtggtggtaccgccaataacaattggctcatacaccaaggttcctgtaggttccaccaaggtataggtacttgatggatacaaggtagtaggagaaaatgtgacaatatcggtctcactggtagttgaagtttttgagacaatggagcaagattcatagatgacgattgtctcaatattagagccattaggataataaacacttggtgcgattgtttgagttgaaaatggttgacttaatatggtggtgaggaactcctgtgtcaaagttgttttctcagtgatggcaattgaagttttgatagtctctgttggagtcaaagtcttggtcgaagaacctaaaatatctaagtaagaataatatccagtggttggtagatcgtatgtcgtctcttgaactgctgagttatgtgtcacatagacagtataggtcaactatgggattggaggagtcaaagtatttgttaaagtagtaatgacatcttcaatccgaatagtacctgtaacaacattagtttttgaagaagtgatagtcgactccttatattgaactgacgtatgcaatttttgagatgtagtcgtccaagaatcagtagtgaagagcaacactgattcatatctagtatcaacagctactctgttaactgatgttgatgaatgctgtgcgacaacagtattgaactctgtagattcaacgaaatgggtggtagtagatggacgttgaacactttgaactgtagaaaacaacgtgttgactgcctgagtttcaaccgaagcagggatctgtaaagttgttgtgatataaacgtgtccattgataactgtatcaattatagacgaaggtgtgtagctggtagcagtaggctcccttcttgtcgtagtgattgttgaagtgacggtatggctgtcaagtggtgtagtagatggagtatcccggccggtagtggaggttgaagttggtgttgaagttggcgataatgtcgaagtagtaattggggtagaggttggggtcgttgtggtagaaggagtagtggatgtagaggtaaatgtagaagtagaggtagatgttgagggagatgtagaggaagatgtagaggtagatgtagtggaaggaggagtgtaaggactgccggagacagagagagtaaccacttcattatttgaagttgtgacaataacaactgtaccttgtagcgaagaagcagtggtaatcaaggaccccgtgaaatctggattggttctggatacatatggcggaataacaatatcctgcgcgacagccgccgaagccaaactgaaagcacccaaaacaaaaatgccgccgaacctcatctataaaactgacaatagactaaatgctcgagcctgtacagggtattagcaaacctgatacgatatgcaatcttcagctgagtattatccgtctgttattgcgttagaaacaagatataggttgaaaccattatctgattcttttgttcatccttttatagtttagaaaaagaagtgaattcccagaaattaataacgagtcgtggattgaacgagatactaaatacctaatctgtatcgatagccgccatttcattttaatataaaaaggacggcggttattttttttttccctctctggttatggctttaacaacactttttccattttcattcatttgtctgttttcctaacaatatggaaggaaaatgacgaggcatgtaaaatctccgataatgaacatcgttcagtcggtatcatgcgtgtcattcttaacccttttaccatgagtaagaatgtgtatatactagccatggcgatcatttgctagacggttagattcccctagatcttagcgagctttgggtagaaaaaatggattggggaaaaaagtgcatcctgtagtttctccgtgaaatcaatccggataaacacttttcccgcttttctcacgttttatttactttgacggaaaaatttttaatctcgggagagtctcttccgaaattcccctcgaacatgaaatgacgcaggagaaagttttccctagatggagcaaagcaagtcaagctaaagagattgctgtggtattcgggactactttattaaagtgggtagaggggggaaagcttcaaacagagcaaagatgtataacctgttaacacccaggttagccaggaaccttccacgtttgcaacttctcttttacgttttttaatgagcgaaatattcaggtttttccgtggtgcagtaaataccccgtacaaattgttttttttttagtttttggcttttttttcccgaggatatatttgttttctgtcgtccctacggaggaatctgtacaaggatataggctaaaactggaaatgaagaagtacagcatctattgaggtctcattgtctcagtagcactctgtgaacagcccacattatgtttttctcctgtttctttctccgtcccagtaaaatgctagcattatactggaaaaaaaaaagcgtccggggttgacaagtgattcgtcttagcattgcctaacagattcggttttttgtggttaaaaaaaaactaatatatatggtttgaggtattcttgtcactttctgagattttgttaaacttcacacgtcaaccatagcggtgttcatcgatagtcgtattatttggacttcctttgtgaaacgaagcaattttgtggcttcaagaatcagttattttatcctgaaatctacgtaatcctctccagtctaatctgcctttttctgaagattctcggaggtaaaaaagaaattcagcaaaacatttctgatattgggttcatcgatattgtaaatattgtgtgagactatcttagtttaaacggggaagtcagtacgacgttttcaagccaagtttgtaaggttgaagatattgcattcccaaaaacacacaaaataaaaagacacgatactggattcatcaagtgatctgctggagttttacaaacctatcatttcagcttatacttccgtttgtttgaccatatcacgggtctttctgctgtaatacttcaaggcaagcttccatattattttggtttttggtcttgttatttggtgactgatacgaaaggaatctggaacttatagcaccaatgacagaggcgattatagagaaaaaaaatcataagaagtctatcaatgatcatgacaaggatggaccaaggccttacgtctgtcccatatgtcaaaggggattccatcgactggaacatcagactaggcacatcagaacacacactggggaaagaccgcatgcatgtgatttcccgggatgttcaaaacgctttagtagaagcgatgaactaacaagacatagaaggatacatgacagtgataaaccaaaggggaaaagaggaaggaaaaagaagagtgagacgatagctcgtgaaaaggaattagaattgcagcggcaaaaacaacgaaacgcaaacgactctgcggctgttgattctgctggtggaacgagcgctaatgtcatagaaccaaaccacaaacttctgaaatccactaattcgattaaacaagatggttcaacatttactgaacctctgaaatcgttgaggtcgaagccaatgtttgatctcggtagcgatgaatcggatgaatgcggtatatatagtgtcccacctattagatctcagaataatagtggtaacatagaccttctgctgaatgctgcaaaatttgagtctgacaaagcctcatcctctttcaaatttattgataaactaccgttgacttcatcttcatcctctccgtcactttcgtttacatctcattcaatcaacaacagcagtagcggactattgttaccaagaccagcttcacgtgctaagctttctgctttatcatcattacaaagaatgacacccttgtctcaaaattcagagtcatataatcattcgcaacagaatctagtacatcttcaccatcccgcacccaaccgaccattgaccgagtttgttgataacgagtatataagtaacggtctgcctagaaccagatcgtggacaaatctgtcggaacagcaatcaccatcgggcttcagctcctctgcacttaactccagattctcgtcatccaatagtctcaaccaactgatagatcaacattcaagaaattcaagtactgtaagcatatctactctactgaagcaagaaaccgtaatctcacaagatgaggatatgagtacagaagatgcatatggccggccacttaagaaatcaaaagccataatgcccatcatgagacctagttctacaatgccaccaagttccggctcagctacagaaggagaattttatgatgaacttcattcaaggcttagatcgatggatcaactgccggtaaggaacagtaaggacgaaaaagattactatttccaaagtcatttttcaagtttactgtgcactccaacgcacagtcctccaccggaaggattgttacccagtttgaatcagaataagccagtgcagttgccatcacttcgaagcttagaccttttaccaccaaaataatgactactaatgaaaatggacagaaatgtaagcgcaccgtctcttcatcgatcaatgtattatattaactcaagatataaaactttcacgcataatgaatatagaattttactagctcttgtccatcaattatatatcatttcatcttagcattctattgacaataaccatccaaaatagactttgtaaagttttcagagaacctgaagcttgcgatcaccgaagatattctgtgttcaggatactggttgtcatgctcgtctgaggaaaaacatctttccatgaagatatcacgtgatatgtttgatattcaaagtttttaaaggctttaaactgcaatagtatcaatcaatttaaaggttgcgtgataggagctgatgcaaccttagtagcaggtcgaaccagttgattttatgaactgacctaatcgcacgtggtacacttatgaatgcagaaaacaataagagacgcccagaagacgaaaatgtctctgtagaggaggctgctaccttgaaaaaagttaagaatttacatacgcataaccgcgaatataccactgttttagttaagaacttgcctccaaattataatcatcataaggttagaagatatttcaaaacttgtggttcgatattacaaatagatgttacagattcaacagatggggattcaaaattggcaaggattgaatttagttcctatgatcaagccctaacagcagtgagcaggactttgaaaaagattggcttccatcagataactgtcgaacagctaacagattctacgatttgggtcaccaattttccacctgggtatgatgccagcaagcttcgaaatttactatcgcagtacattgattcaccaattttgagtattagattgccgtccttagcgttcaattcaagaagaagatttgcatatgttgatttagtttctccagaagtggcaaagaaagctacaaataggctcaatgggatagagatcaacaattataaattagtagcgaaaatatcgaatgtcaacgaacgaactgaaaggactgacaatgccatatcggatggtagagagataatagttaagaaccttccagatgatattaccatcgatgatttgataaagatgttcaatgagtttggtgatacagaaaaagctagaatagtaactggtgatgaaacaaaccctggacgacattccagatatgcgttcataacattcaaaaacaaagcgagtgcagataatgctttgtcattaaatggagcggtaatgaacggtaagccattacacgtttcaaaagttatgagaaaggcttatctagaaagacaagaggtgaagcgtctgcttgcttccagaaaagaaaacccaaaagttgtcggaatatacccattgtctgatcagattaccccagatcaaattcttgctttcattacggagaaagctcaaattagacctccggatattacgaaggttttgctggtctctgatcatgaaggtgctttaataatagcggacaaagaagcaattaccgcaaaagtttcacttgcaatcaatggatacaagttcaagaaccgaattttgaaatgtgtttctgctcatgaactttcccttcattatcccaatgaacacaaaacaaccttgaatcaaccaaagcacgctgttgtaaaggaaattaaatcacagcaagcgtcacaaaatgacaaaaagttgagcaatgatgacttcagaaaattatttctatctaaataatattaatactatataaacctacctgtttataaatctgacatcaaggatgattgaagttctgagatttgcttggtgatagaatgtagaagctgatttctatagacctcatcttccatcatcttttgtttgtctggggttgtcgcgatgatccgagaattcatatactttgggtgagttaacaaatgtttcaatacatttgccaaatcgtttctctcagagctagtgtctaaaccagggaacaactctattatctcttcttcgtcaatgaccttcaatttggaaccattaacagacaaataacgctgatattcaagtttatctagcattttctgcaaaagaattatctgggaagtctcctggatatatgcttgagttatggacagtgagtcagacgaccagccccccacagcaagatctatttgtttggagaaatatgaaacaaatagacacacttccgaaagtattccagatccgaatttacttaatagttgaagaataatcgatatgatgccattggaccatatgttatgcaatcttggtgataattctgggcgagccccagattgttgaattgacaccgaaatcggactttccaagaacacagagaagagcccgttatctataatcttttgtgcaacttcttcaattgtgacaagctcagaaatgaatgacagggttagctccgcgaataagggttcatcatgagatctgaaaagatatgaactgtagtaaagattcaaaagtgattttaaggttccaaattcatttagcgaggatgccaatacagcgttaaaggatgtcgaagggttcagttctttgatttttgtgaaaagggatagtaatagtaacaaatcttgaattttgtcggcaagatttggcacaataacttttttacctttgttggaggctattgtgaatgagaataatatagaagacaagatcaaattaacaccttttgaaaaagctaactcgaagacttccaatagactatcagaatatctttctgaaaacatagggtaaggttttgccaaagttaacaacatcaaaatcgaacgaagaataggtctatattgattattcttattcgattgtgcgatatttccgaggtaatctacctctttagactttaaaattgccaaaagctgtgacaatagagtttcaagcttatcctcaggtatcttcatagaagtttgtaagaatgaatacagtatgtaaaacaccaattcgattcttaggaggtatatttcagagaagataggtgcctccacaccatgctcaacatttagtgcgagtagttgggtaacaatatcgacatatgaagcttgtaaaggctttggagttttcttaatgaatgcggtcaaaagagctccccatgattttgctgctgaaatttggaaagacacatattgtaagttgatagagctttttataacttgttctctaaaccctggagtggacccgttccctctccatttttcttcacaacagaagaactgatcaagaagttcaatgtcatatatgttcgcctggtacgccttaccgattctataaagtggtgaaatagcgaatttttctatatccagatgaggccaaatctttttgaattcctctgcgagagtcaaatgaagagttttatcatatccgtctatagaaaatatcctcttaacgatatcaacaagttggggtccatttaacatgtttgttatggtggaatctgaaggtgaagaggtgaatagatgaagggcaaatatttcagcaatcctcgcttgaagacgatagtgactggataatttaatcgtcgcctcaaccgaatcgggagccaacttgtcctcgaacttttctagccttttgacgagaaaatctataaattctttatctgctgtattattccttgcagcagcccaagagttgaatgcatatgagattgcttcaagaagtcgagaagccacagattccgggtagcaatctagcttcaagacatttttcttaaggagagaaagaattgatgtttcagaggcgctattcgatggttctgatttttttggggaagagccaacggatatggtttcgccagtaactaaaagaatagagaaaccatcctgctttccttccataacggaagaaaagaatctgtataaactcttcagaaattgataatcatcgattgtacttgcgaggtcgtacaagatcgaattgaaaatcatcttggagtgtttttggcccagatacgataaaagagatgggaagttttcggcccaaggggctctcacaaggtgcgtcatgagtttgattattggatttcttaaatcattgtgtaaggcgtaaatgtcaattaacttcggcaagttgccatatatttgtgattccagagtgctgggaggtaattgtaacattgcacggacggagattaaaaggtttgctaattcataagacttcagcaaacattggttgtacttattgtaaaagacttcatttccgatagagagtgcttccaatgagttgctggataatagaacatgcagtatggaagtgactgttcttacatctggtgagtcagaacttaaaaagcgattcgttatgtcgtttgcagctgatgataggactttagtaattttagtttctggcggattagatggatcgataccataaatattgtaaacgacagtcgtaaacaagatggttaagtttgttcctagctcatatttctcagctatggaacgatagttccagtattgataactttcataaacatgtatgaaatgctgaaagaatttcgaaagaatttcctttttcagattttctgggaattctgtctctagtgttagagattctagaactaattgttgcgccaatttgataatcttgattgttattgagtagtttccatttggtaattccatggtgcccaagacactagaaatcaatccggatttgccatacctatcaaggagttcagatcttgctaaatgcgaccatacgaactgagaaaagtcatctatggaactgatgagtaggttgagacaatgatcaataacgtcatagtctcttaaatgcaaagattgttcgaagactttgaaaataacatcaaaaatgtaatcttctgtaagataggtagacatttgtagtagaatatcggccgatttctccaccgagataccacttcctataacactagaaattagatccagcattgataatatcatttcctgaacatcagaatcttgaacaccagcagatgaagtggacagatatctatcgcatgcattttgaaggactctacccaataatgaccaaccgttatatttatacaagaacatcacgacgtcatcattagttactgaaggtaagatcttagccttcgtgtccttcggaattggtaagagaacattcccactaggttccaacggtactcgagcaaaggtctcactctttatggatatcaaatctgttgagtgtgcatcatcagctaagtcgtactctagacttcccaatacaacctcttggacataggtgggaagttccttccactcaaaatttgcaaattcagcattcgctgaggttatgtttatcattggaatgagtgactctttcaacagcggagcctttgtttttatcaagaagaattttttctcaaattctttgtttgtcaagaacttttccacataatgagttggtgcgttactgaggacagttttgatcattttggaagtctttatactgattggaacgaaatacaacgaaaaagtgatgaaggaagtcagtatagccgcaaagaaggcttgatctttgaatatttgtgaaaccttagaaatctcttcgaaaacattttcattctctgcagtaagggcaaactctttgattagcttcgaaatgggttgtgagttgaagacttgctgcacgaattccagattattttcaggatcttcttctaacagatacgatttggaatataagatgaaagaccagtagtatacaataattgctggcggatctgtgtttattatgagatctagaagccttctgaaagtcgcagcgtcattaaaaaaagacgattttacgtctatcgtgtcttcgcttgtattatatcctgtcattataatagtatccattatcattaaagaatttgccatgttgtagatctctgatgggacatctttattatccttgagtatggcgaaatactgtgtttcttcgagcaactcgtaccattttgtgataatttccagacccactggttgattcaagcttacgaatgcgatcaaattcaatagatttgtaatataaataagatcatacgacattaatgagctcttataagaatcattttgctctgctgagccgataagtgctacacagttcttgaccagaagaattgcttctgatatcattgtggacctattcttgtagacaagttgtaacatggagccctttaaaactgggaaagaatcatgatttaataaaacgagggttgtatccaagacacagtttctttcatgtaagatctgtttaacgatggtatctttttccattggacaatctgggaacctggtcctggtctgcgaaataactctcaaacactctttttgatgtacatttaacgcaattgaaagctcattggccaatttttcgtcctctaccgtcacattatatgaataacccctcaattgcagctgttttccaacggaatcagtgttttcaactgaggtaaacctcgaaagatgaaccagtatctcttcgttgtccttcaagaatttatcgattgcctggaaagtaggctcattatgtaccttatcgtattccccagagcggagaaacgcacaaattccagcaaatgataaagatgacatgctgcacggtacacctggccagcgcaatagcctttagttgacgtgaatctgtaccactgtctcatcgtcttaattgttagatcgaatagtttcattaaatatagttttgtttacattaaaattttgcactacatatgagagagggtaacatcaaaatattggacatgtatatcataaaggcataataagaggagatgagctgtgccaggttaacctaaccgaagaagcttactgaccactgactgcttttaagttcatacatagtaccatttgtccacttcttgtgggattggtgtgtcattttgttgattaggttcaactcttatgtgagttcccgctctgacaatggagggaatctcggcctctgatccatctgctttaatttctcccctaactagagcattccaggcttcgtgacattcttgtaccgtagaaagtgtagatgcttggtcctggtactcaccttcgaatgcaaacacattaggttgtttcccagcaggaatcttgtaatctctgaaccatgttctagttgcatccaagagaccaggcataacagtgtctacatctgccaacttgttcaattttatagcaatgggatcttcaatgtcgatacaaatgactttccaatcgagttctccatcgtcaatgagggctaatgaccctagaagctttacttttttgatatctcccattttggcgatgctggaaccaatttcacaacagtccaatgggtcattatcacccttgaaaccgggcaatacttcaataagtggctgttcccatgtctgtgggatagccccatagttatgaatgtatccatggtaagggaaaatgttattgacaaatcgtggcttgcctttctttatgtcctgtgtgatggggttaaatggttcggtcttactgatttcaaacttcccattactccaacgtggaacctctacgatcatgttacatgttttggcatcaacatctaagtctaatggcacatcgtggaaataggacccaatttcaccgtttggcagctgcaagtactgtttaaaagacgatgagtatttgcttccaaccaaaacgttgtggtagtttctagcatgtaaatggttgccaatcaacctcaaatgttgcgaagcccttctcatatctctagacatcaattcccacacagcaactatggaatgaatcctttctgtgggatacccagactcgactggaccacgattccttagtgtttggttgtaattcggtaagcttgaaatttaatagacaaattattatttaatcagtgattagtggaaatattacaaaaagataaattaaaagcttacacaacatggtaagagaaaatggcttagattggatcttgacgattattcctctctctgaagattatcttcatcttgttcgtcaaacggattagatacaacttgcatttgagaatcattgtaagaaggtggagcagtttcccactcaatagagccagattctgtgaaacgagcaccttcatcagaaatttcaacgacaccagctaaatcagcaatctgaactgtagagaatccatatggatcacgaggaatccataggaatggacatttagctgagactgttgggaaatcgtatgcatgcttgatttctttttcatcggttatttctgttggatctggtagattgtagatctcgggcaatcttgttttcacagccttgtaagaatagtagatgtgagggagtaagaaccttttccagaatggagctggtggcactggagtcatgtcaccgtctgctagcaatggaactgtgttcaaagtgttttcattatcggtatcaaagacaccagtttggatttcgtaagtgttgtcactcagaatggatgtagttctttggtcgaattgtgacgaggaacgaggatggtacttcttgatttggaatggtggcaattccttgatttcatccttttctggttcaacgaaatctctgatgtaagatggtgtgtttgatttaccatccaatgccttcattgtatcaacaggttcaaaggccattaaatggtcaaatgctgaattgaagtttagatgaacgaaaacagtgacacctagacaaatggcttgtagcacgattggaccccaacctttaccaacaacaaagagacccaacaaacaaatttgtcccaagtacaaaccgaccattgtttggaacaaagcccttgggtaatggattccacgggaatctggagattcctggaacacatacgtcaaattgtaaaggtaagcaacgtataataggaagaatgcaacacatgcaaacagcaagatcaatggagagatgatcgcgtaggagaaagtgataacagccaagttagtgtaaacagggaatgtagtaccccacgccattgaggatagtgaagtgaatctagcgtacttttttcttgcagtagaatcaaggaacatccccaacacgaagaacaagatcaaaggcacgatttgcagcaaggcacctgatgagatggataaaccttgtagaatgatgtaaccgacgtagaaattggaactcttaggtaaattctcagccaacaagttcatcgcggaagttggctcttcgacgatggcagtaacagtagaagtagcagaggaggccaacgtggtaactaagaacacttggataacttggaatgcgaaataagcttgttgagtgaaatattcaacatgctggtaagaaggtgcgccagcgattaaggccatctttctaatgaagataggcaacagcatcattaacacggccaacgcgatggttggagccaaactggttatgataccaagcaattgatctggcatgttgtagataaatttcaaccatggtaatttgttagtcaagtaggtgatattggagaccataccgacaaatgcaacggggaaagcccacaagatgaccaaggcaacaatggcagcaatactaccgaattttctaaccaatctttccaaccagaacattctcaagttgaaccattgaacgtctgtaggcgagataccgacgtacgctggagtcaatgacaatggtgaatggtgactaaccatttggaccgctttctgagcatcgtactgagtattgaattcgacaaagacggaattcattggtttttcttccatatgtttgttttgcaactcttgaatctttgcatttagttcaggcaacttctcctttgcatagttgatagtatccactttcttaccaataacaggtttcaacctatgagaaggtcttttcttctctggcacgtattgagtaatatcgttagcaatcttacttggatcggcaccacctttcttcttcttttccttgctaatggctttaactgccatcttcaagtaagaggtctcagcagcttccaacttgagagccaaagcatctctctctttaaccaatttactcaattgcttcgcacttctagcgatccaaatgttcttagtatgttcaaacaacttggcgaattcagtttcagacaagtactgatccggaacagattggaacaacacggtccttgaggataacttcttagcgtaacgtggagatgcaaggatactgtgtctcaacgagttgtaaagggtcaattccctatagatgacgaacaagaacccccaatagaatatccagccacaaaacacgtgaccgtaatatcttcccttctccgtaacgttggagtaagccaacatatcgaaacctttcttagcaacaccattgactgcgttgatagggagcaacacggggaacatatacagcattgaaaaaccacagtaagcagaaataatgaaaaggtatctgataaagaaatacccatcgagcccggcttgttgaatgataaaattatccgatttcttcaacaaaggaacaatccattgccaaataccactgggcaaaggctgaggctttttctcatcattaatcaaatcaaaggatgacttaggttggtagatacgcttgatcttgagtcttaaaaggataaaagagatgaaaaacacagcgaaaacaacaatgttaaacaccaaagacgtcacaacttgggacgtcgaggtgttcctcgtatcatcatcatcagaggaagccattgtgctcgtgtttgttccttagatcctgggaacagagcaagatcgtgcacgtataatacaatacactaataccaatgacgaacctaaacgtatcttagatctgaatcaaaaaaacttttcacaaatcaggcttatataaggtcatttggtacttgataattagtatctaattattatgtgaataatgaaactagaggcagagaaacacggaaagagctagggcgagagaaagaaagaaaagtgtgttcgccagaacaacgcacagaaaggatacacatttcacggtactatattccacgttaagattccgtgctgatttcagaacctaaaacagaaacttgttcgagcctttttacttttcggccagagaacaaagcacagaccaggccggttgtctgtatgaaacaatttttcactgtgatgaggtgaaaaagaaaaagaatacagtgcgatacggaatctctagtcgggttctcgaggctgctttcgcggccctaaacattctgggtgtacgttatcatcagtgcgatgcggatagtgcgaagggcagtgcaacggaactggccagtgcttttggtagtcaatatccgggtaacaatcatgaaataaattcaatctcatctctcttttgaagaaatgattcagtagtacttcggtgtagatatgacacaagtgtggtgttaattggtgtggtctggtaccgtaggtaccagaccttagttgcaaggtcaagtttctccaattttttgatgcaaggtgccaattggaaagagcatgaggtgcttcagaggtggtcttctgtgaaattggcacagttcccgcagtgtaagaattctgaagtgacaaagatccatatctatgatttcgatcaaacgttatttgtttcgccgctgccgaaccctgttttgtacccgccatcgacaattaaccatttgaggtatcctaattctttggctaatggaggttggttcatgaatagcgatattcttgagtattcggttctatgtaggaagggtaaagattcagggaaatggaatttaacagtggcagaattggtgtctatgtccattgctgatgagaacacgttatgtatcctgcttacaggacgctcggaggctcagttcacgagggttatcgaggaagcgatgaaacagtttcaagaggattttgaattgtcccgtgggtttgatgctgtttgcttgaaaaaggaacagatgacgacagcaagttataagacttcgcttattgtatcgttgttggacttttacagtaacgtgaaccagatatctatatacgatgaccgggaaagacattgcaagatgttccgcgagttcctgaagaactatgcggagacagttcggcccgcgttgataccctctgtagtgatcgtaccggcgatcttttactatctcccatcagatgtggagatagagctagttcacaacatggtcgctgacagcaataaaattgtgcaatccatcaatgagaggaagaagcaccagaagcaccaaaagaagaaatctttcaataagtctggtgtttctaacggcaattttaacattttccaccttcacaactctgcgatgcactcgtcttacgcgctggacgtcgagacgacgataagattgcaagaaaaagcgatacacttccttaagagtttcgaagacctcgatgcagacgctatccccgaatcgttagattggttcctttacccgtatatcccaataagccttcacgaatcagttgccaaagtgagtgtcaatgatatagctgaattgttgcatgaagatgggaatgtaagagatgccaactcccttgcttcaaatatccaaaaaggtcaccaataccaccaaagatcttggcaaattaaggactttgtatatgttgctcatggaaacgttattggattccgtgttgaaccagcagatactgtgtcagaggtgcctgcgtcatcatattacacgtatctgcttctcgcgggcccgaaaagcatttcgttttatacttctcaagaaatgcacaacttgagaaatgcattccatcattactttgttatagattcgaaagaccaggaggtcttcactacgtatttgggagtatatcacaactttagattgaagagtgccagataaatgtcgtaatagaatcgaattatctacattatatttagtttctcgacttggtgaaaaaggaactgaacatctaggaatgacaaagctgctaatcttcgtttgcatggcctctggggttgttctctcttatttgcttgtatatttatttgtatcactcttagatctgtgtgtgcctaactcttcaaatagtcgaaaagaaatgtacaacttttgtctgtttagaactatatacatcacaatgatataagctgatctgcaataaatagatcaaataaagtagctacatctcctatttattggtgttgagaggtgctataggatacccaaaccaactaaaacaagaaagagtatggaacacagtgttttattcgagtggaatagtgttgattctgctttacacgttccggcgttaccacgcggtgggattcacaaaatatgcatctacgatttcgataatacgctatttaaatcaccagcaccaaacccacacttgtattcagcagagttatattcgtcactgttgagcccgcatgtgttcagtaacggtggatggtggtcagagccaaggttcttggagattttggttgacgaatggataaagggttctgtcgatgactcagcattttggaataaagacatcgtagactccgctagaaggtcctgggacgatagggataacggtacgttgacgatactaatgacaggaagaaagcagctgttgttcagccctctttttgaaaagttactaaaacatcccgtgttcggccgggaattattgttccattctgctttccttaagagagctggttacccaaccacgatgaagtataagatcgcatgcctgcgttctgtgatggatttctacaaggaagtgaatgagattgtgatatatgatgataggaaacagcaacttgaagggttcgaacttttctttgaggactacaagagggaaacttctcgtaatttcaatcatacattaattgcggtaaaaccggtgataaattatttacctccaggaaaggagattggtaccgttgcaaagatatttaacgaacacaacaaggatgttcgttcgaagttggaaggtcttgaaatggttcatggcccaatttgttcattagggttccaaatggacaatcttaccttggatgaagattcgaataccgttcggtatttgctggattgccgagaaacacacaagatccgtcaactggttactcaaatgtcgcaagacaccaatcaagcgtatccgttctcacttccgatcatagtaccattaggttcgttacctgggtcccaagtggaaatgttccaaaatcacaactccgtgacaccagaagcgtctacagaagattttaggaaactgattggtgatgctacatgcttctgtcccaacaaagtcatagactggtccatccgtgaagcaatctctttggaatcatcaagattggcattttccgtcggctcgacccaacaaccgggaacccatatattgttcacttcggactactcagatgaagatatgcaaagtgtgatggaccacatcaacaacagggggtctcttgctgaaataaaccactcactacccagtttctcagcaatagctattccaaaataccattatctggcaaagacagcatgcgacgttgaataagtactagaaacaagacgtcagacactagatctggttaacgacaaggacaaaaagaacaagaacatacatacaaacataaacccaaggctataataaataattttaaactaaatataaaattgtggggaacttcatttgtattccaatccaaagggtatagaactggttctcacgaacagatctatcataaattgaaataattgtaaacaaagactccaagaggatgttccttgtatttcaaaggaccctcagatgcacatttcattggtgcacacccgaagtaccacacctctccagttagcagttcatttaagcacaataacggctccagtagtctattgaaagaaaagtttactgggaatttgactgatgcgctgagtaaaattctcctgaatctcaacgcattggtatctgctgataccactacaaacttcccaagtataaaatgttgcaatagatgcaacagttgatctgatctgatctgtgagtacagtttcagacagctcgagcctgagttatgactaaagtaatggtgacagatctgaaaattttttcaaactgactgaatttatattgaaaaaaactgttatttcagtctactatagggctattatattgaaaaaaagagaaaagacaggcggaagggggttgtatgtcgtgttcactacctttattcagtgttggaatatttctaatggcataaggttcccatcatgcaatgtatatattcatttaaatatccaatttgctgctgtatcgctgatattctttccttaagaaatcgaattcctcagtaaaagacgatacacgtaaacaatctggaaaaaaaaagaatatcaggcattgaagggaaaggtaacgttgatctaaagagttataacgaaatttgttaacgcactagtagagtaattctgagctcataagataggactagttcaatttatctcagttcgagtagagaaagtggaaaaaatggtacaatccgagagtttacagatatattggcatgactctcatccgatatactcgttatgttttcaacccttatcagagactaaccagaacactagacggttgttcacttcgggaggtgacaataaaatcagggtctggcaattgaatgagagcgaaaatgatgggaagatagagacaattgattttctttcgtcgttgacgcagcacgaacaagctgtcaacgtttgtcgattcaataagcaaggtgacacgttagccacggcgggagacgatgggttattgttactatggaagaagaacgagactatggtaaaggaatttggtgtagatgatgatgaattccaagattttaaggaatcgtgggctgtatggaagcgattaaggtcagggtcagcctcgaatgccgagatttatgatatttcatggaaccctcagggaacgtgcatagctattgcatctttggataacaccgtacgagtgttcaatgtggatcagggaaaagtggtaggacatataacggagcataatcattacgtgcaagggattgtatgggaccctcagggagaatttatcgtatcgcaatctgcagacagatcattggcgatttgtaagatgatttatgaggacaacgaagtaaagggcttacaattagtgaataaaatattaaaatcagaactaccaaggaggaaaaatcctggtgaaaaagaactcgattttgataagtcgaaggtgactttcttattccataacgaaacccttccgtcatttttcagaaggctgtccatgtcaccatgcggcagtctcttatgtgtaccagctggggtcttcagaaatgatgaacaaacggatgcctcaaataataacccagagtacgcgaatgccgtatatatttacacaagggcttctctaacttcaaattcaaacaaacccgtgttttcactaccctttctacaaaaaccggcattagtggtcaagtttaatcctatcatgtacgaaaccgcgtctgaatgggtgaaagcaccttatacactggtattcgctgtagcaactacgaatgaagtgctggtgtacgacacacaaaataccagtcctatagcgatcgcaggaaatttgcattatacccccataacagatcttgcgtggagccaagacggaacattactaatgatatcaagcacagacgggttctgctcatatattcacttcacagacaatgattttggcacacctttgaaagatcaatctataccaatcttgacgaaggaactcgaatcacaatcgcaatcacaatcacaaccagaatcatcacaaaaggctagtatcgtaaatcttagtaccggtgccgccgaaactccaaacccttcaccagctaaaagatcgatctcgcagcttgtctcagaagctgcaaccacagttggaaaggagaagctcaaacgcagggttcaacctactctcgtcacatcagatcaacctaaatagaactagattagtttatagagagggagatggcggaataacacgtgactttgaactgttctctacgcaataattactgtgtatagtagtaagtaataatcgccgagttaagattcgagacaccagccgattgccttattgccaagcccgtgacaagaatcagggtgttggcagttctaggaggtagaaacagaaaggtctgggaaacaatatagaaacaaaataggaaatgcaaaaaaatggttagtcacgtgatcaacatttctctctggaaagacatctagctgtaaaggacacactctagcatgtaattgagaatggatttcatttactggtatatgtacgatttatagatatctacacaattgtacctatcatttcagtagagactgtaggtattcactgttttccacctttagttccatactctttcttgcctgccataccattaatctctttctttcttctatggaaagatcgttgggattcaagtttgaaagatcttcttgtggatccacgttgaatttttttagcagattgtcagctttaatgttggatcttttccgtggatctgtagatgtgctattgttgtttgtattgtttcctgtagttacagagcttccggtcgattgattttgaccattggaagaattgccacctgtttcagattctgggacgtaatctggtgggaatggcatatctctacccgagagatatctttctacagtagtttcaactgatccggtttgttccaagtcgtatctgatctgttctggatgtagatgtggagccaaggattgtaccacttcgatcatatcatcgttgactctacgacgaatacgccttctagtctgtcttgaagcggcattacttgacgcggcggtacctgaagccgtggcagagtctgattgcgaagaaaaaccattgatttggatggatggatgttgttcgttattgctcaaaaaccatttcacagcaatataaccggcaatagccaaaatgataaataatgtgaaactttgatccgccatgattaaagttttaattcagatactctatctaacacaataatttctgtctgctctcaatatattgctgtgatattaattattctggagacaggaaaacacagtatgcctggttatggagcaaatacttgtcttgttacagtttttacttgtgaatgataattaatatcattcatttcttattaaagagaaaaattgtgtaaacgacctgtaaaggaaaaaaatgttaaagagcagaaggacgtgtgtacagcttgctgtgcaatctgtccttttcactgcagtgcatataatcagcgtatagaacgctagttccaaatagatttccgttgatatccttgattattacgttctatattattcatatatgttacaaatagatgaagccattaggctgatgtcgaattacatgcccaagatggaagtgagctatgcaacaccaccgcttcatcccttaaactccattctgaacttctttttctgattttgtactttgtaaataaactgaggaaggcattccgcttctcgaacggtatagttatcgaagtgttccctgacacctttcgcaagctcctgcttcgtaacccttgcatctggtacatttttctggtttcgtttcgccgagtaagtatgtttcccaatccttgatcctagaaggtacccttgtattgatagattatctggagatttcaattggaacctatccttataccgccttaaaaattcatcggagtattgttcgaaatccatcggatttgggagcggctcattcttcggatgattgttatgtatatgtttcttgttcaagtccttcaagtattgctgttgagcactcgagagtctttgtttcacactggtcctggtcgatgcacctgaagttgcattgttcgatgatttgcccttagattcggactctgaatttgagttattgtgtccccttggtgccatgtcgtgtaagatccttgtgactgtacagcacccactctatttgacacctgagatggtatggagcagtacatggtaatgccctttaccacctggacaaatgttcaaaaagatcaaaattttgtacttaagacacttttttttcttagataagtgggaataacttggaattagatatagaggatgactacattaaacaaagaacatacatgcagtccctgcgtctcatctcatttacgtaagaatctattgaagttttgtaataccgtgtccatcgccttagtcctggaaatgccgtgagctcttgaaatggcgtcaagaacggaatctagcatctgtcgttgctcttgcgacgacactgaatccacagaacaatctgtctctgtcaaaatacactgcaagggcaaactcttcaacagctcagcaccagaatcccagtctttcaagttgatccaacacgaaacgctaaagaaaagccgttcatgtgggaaattcgccagccatagccgcaccgtatccaatgtcccagtaaacgagtgcaaacatatgttcacctcgctatccaataatattctcttgcaaatatcaaaagtagtaccttgacatttcacagaatggatcgaaaccggcaacccccttccctttgcaacttttaataacgtttcaaatacctggatctgatgtgcaaactctacccttacattgcttaaactacttctttccaacgatgtcccattattgctcacgagaaagccattctgaggcaaccgaaaaaccttgtccaatccgatctcgccaatacaacccacacgagaaacccgctcatctgacaagtaacttgacaaatctactggatccggcaattgctctaccaattccatcaactgtacctcgtctttacatttaagacaattcctataatgccctaccttagaaagcgacctatctaactgatataaatggcaataccagggatgcacaccaagactaacattgattccgggaccttcatcatccagttgtttcattagcagcaggggctccagtaattcccagtcgtacacattcgtgctcatgacacaccgttggacatcacttgccgttccggcaagggccaggtccaaattgcttctgatcttatcgcatcctacagcatccaccatagtagacacatggcaatgtgcatcgacaagacatggaaccattcttgccccacaaaaccaagcccaattaccactcacctgatagcagactggaaccctaattccatagcaattgccttaattgtcccaattcaccaatatgttccaaaggtatactttttgaatcacctgggactctttctatcggaaaatcatggaaattgagttgccggaaaaactattgttttgggggctcccacaaccccgttttcgggctgcccccaaaaaaaattcccagatttgcctttaaacatgttttcaacatcggatttcgcaaagactgaaccttaaaaagcagaccaacttatgtcctgtctatatttgtatataaagatgtggaaatcaagtggtgtgtttgggttagctactcctttttatcatatattcatccttttatttatcttctgatactaagttcttaaatatacatatcatagaattatcataggtaattgctttgttaagttctaggttttagggcactaaagagtgaatattttttttttatttcgaaggataaacgatggttgttattattgcttctttgttcttaccatttcagcctcaatttgagattcattcgtcttccgttgagactgcgtcgttggtagatcaaccggttaagattcgcaatgctggttccggtgtaaaaagctctgcgaattctttgtattccggtaatccgttcgatttgggtacttctttgacgaggaaaagaagtagctcgtcgcattctcggtcttcttttgcgccattggatctgactatgagtgctgcttctggtggcgatggcatggagtcatcgcctgctccgtctggtgagttttccaatcagcatcgactcgatgaggtgacgaaacctgtgggtgctaatccgcaaatctcttccgagtcgtttatggaaagtttgacggggaaagcacactcagctgcagcttcttcttctaagaacgctctttcgaattatcctactgggtccgtggaagaattcttttctagtgggaacacacagttaggtaagaattacgataacaatacaggttcaccagattcgacatactcaatccagtcgagtcctgtgattagtgctgtgaacccgacacacgattcgacgtccaatttgttgaagaacgttaacaaatcattactctatcagatagtgttgaatgaatcaaattctgcgtctgcgttggagggtacttccaaacatttctggaatagtcccggtagtacagttattactccgagatctagggcgttaccggatgtgaatagtagtttatccggtgttgctaagggtaagggccatttgcacatcaagtcacaagctccagctattagacatgtgcatcccgctgcgcagggtcccggcaacgtgacggggacgaccggtggtggtggtggtggttcttcgaaattgaagtattcggtcaacgctaatcatgatgaggatagccaggaagagaaatatgaacagtcagaacaagaagagggcgaagaagaaaatgatgaaaacgagaacgtagtggatgatgaggacgaggatatgtatgatatagaagaattggattcttctggaaggtatcattacaatgtccccaagtttggtggctactcgaataaagcaaaacttaaaaatgcgctattaaagaagtcagagaatattttcagtaccgctccttggaccattgtgccctgtgctaaggggaatggtggtctcaagaacgccgttgccacggcgctacttgaaaagactatagatgagcaagttacttgggtcggtaccgtgggtattccaacagattgtatcccggagaaaactttggataacatatgccatgagttatacacaaactatcattcaagggctgttatctctgatgatttgacattcaaaggcgcctataaaaatttctgtaaacagattttatggccgactttgcactaccagatccctgataacccaaactcaaaggcgtttgaagaccattcgtggaattattaccaacatctaaaccaattgttcgctaacgaaattgtgaagacctacaaggaaggtgacatagtttgggtgaatgattaccatttgatgttggttccagaaatggtcagagaaaaattacccgatgccaagattggattctttttacatatctccttcccaagtagcgaggtattccgttgtttccctcagagagagaaaattttaaatggtatcttgggtgctaattccgttggattccaaacagatgaatatgctaggcatttcatgcaaactgctacaaggttgttgatgactgacgctgacgatcatcaactaaaattacaaggaagagttgtgaaagtgaataacactcctattggtgtcgatgtgttcaacttggatgaacagatcgatactgaacaagtgattcaatggaggaaactgattagagaaagatggtctgataaacgtttaatcgtttgcagggatcaattcgatcgtattcgtggtttgaaaaagaaaatgttggcatacgaaagattcttgaaagaaaacccagagtacgttgataaagtggtgatgattcaaatatgtcttgatactgcccgtgacattgacttggaaagagatatcatgtctgtagtggacagaatcaatgctttatcaaaggacatcagtatctcgcaaccggtagtatttttacatcaagatcttgagttttctcagtatttagcactcaactgcgaggccgatttatttatagtcagttctatgagagaaggtatgaacttgacttgtcatgagtttgtagtatgttccagagaacgtaatgcacctctgctactatcagaatttactggtagtacgcagatcttgaagagcggtgcattgttaatcaacccatgggatatcaagaagtttgcgcgtgctatcaaaatcggattggagatgccacctgatgaaaagagacgccgttggaagaaaatgttcaaaagtgttattaatcatgactctgacaactggatcgttcatgctcttaacaacattgattcttcttgggaattcaatcacgaaagatcccaggtgttcaacttgtctttcaaacaaatgtatgctgcttatagccaagctaagagacacatgttcgtgttgaaaatttctgagccaccaactcctagaatgttaaggatcttatctgaactaagtgccaataacattgtctatttgatgaactctaattcacgcggagtgttagagagactctacagccgtgtttccaatgttggactcattgctgaaaacggtgcatacgtgagattgaacggtaattggttcaacattgttgaagacgtatcttggaaagatgatgtcatcaaagttttcgaagacaagatggaaagactacccggttcttactgcaagatcggagattcgatggtgagattccatacagaaaatgcagaagaccgtgatcgtgtgcaaggtgttattggcgaagcaatgacacatatcaacaccttgttttcagacaagggtatccatgcctacgttaataaaaacattgtgtttgtgcaagaagtcggattagcattgaaaacgttgcaattcttggtgagctattataattctgttgatgacatttcatgttcatctcattctccagtggcgcaaccaacttctgctgaaacgtccgcatcccccctcctatctccaatatctccaaagaacggtgctggtttcttccacgttgctgccaagagggaaaatagagacccaattggattcctaacgatcactgggtccacgtctcccgttattgaaccattgttccaatacgtcaatgaactcacgaaggaaggaaagcttcagtacgggtactctgtagtacatggtgatacgtcttcaacatacgctaaagagcacattcagggtcttaacgagctattttcgatgctacaaaagttgtcttctcccaactcatcctaaaagagatagaacaaatctgatccttcccataatataaataaagagaatctgtatagtttacgataatgtgataaagatgctggtttaagatatgtgaggcataagcaacgcatcagtcaccggtacggacataaatgcggtatcctatgacatcacgtgatataatcactctggacgagttgaaaaattttaggtttcagaccaaacgcctacaataagcaatgactttaaagaactgatgagatgaatagactagattacttgaggttttaacgttcatattgttgttgtactagtcttttagcattctgcagtgatagaactagaaaatccataactgtaaagatgggtaagaagaatactaaaggtggtaagaaaggtagaagaggtaagaatgactctgatggtccaaagcgtgagttgatctacaaggaagaaggtcaagagtatgctcaaattaccaagatgttgggtaacggtagagtggaggccagttgttttgacgatgtcaagagaatggctcacatcagaggtaagttgagaaagagagtgtggatgtcccaaggtgatattatcttagtttctctaagagatttccaagatgaccaatgtgatgtggtgcataagtacaacacagatgaagccagaactttgaagagtcaaggtgagttgccagagaatgccaagatcaacgaaactgacaacttcggtttcgaatccgacgacgaagtcaacttcgagttcggtaacgcggattctgatgaagatgaagatgatgaagaagctggtgatttcgatatcgatgacatttaagcatctcattatttaacacaaaaacgtatacataccaaccaacacacaaaatatcacaactttcgattcattactgcgcgcataccatctaataacttcaaggtgcgctggtggatgttatttaatgctaaacaaaaaattgcaaccactctgttacactatatatatgcatatatttatatatatttgaatatatcttctttgacgtaagtacctttaataagtgcttagcctcgatctagtcatgtttggcaatttttctatccatgtgtatgtgtggtttttgaatgcatgagcttttatagtaccctcaaatttcgaagtcatcttctttgttggtggctgaagaaagatgaaccatttcttcatcctgataatttacaatggatccagttctttggtgtgcacttcttgtgtgttggaaagattttcttgccgagaacgcaccgacgttgttatccaatgggatgttttcaacgtccggttgatcaccaaacattttggcatggttcttcttacgagataggttcaaaaggtaaacaccaaggaagatgatgacgaacccgcacaccaaggataaagaatcttttggatcactgtcttcgaaattcttaaataagatgaacgaggctgttagagtagctgtagtgaacgtaacgtagtataatgggttgacaatagatgtatcgaattgatccaatgccttgttgaaatagttcatctgtgtcatgatgcatacagcaacgacgatgaggaaaaggtaggtagaagggtgtgtaaactggttgctgccacttaaagttaactttaaggcaataccaaaagctttgatagccatcactgagatggaccccactaaagagcagatggagatatacaccatagggttcttcgtaccataatgtggaacgactttgtagatcatgaacaatgagaacgtacttaccacgataatgtaaaatacgaatgccggttgcatggcataccctagaatctcatcaactgtagagatctccttatcagaaggcgcatgcaggatgataataattgaaccaagtaaacagatggtacatcctagcttaccaagtgtacctaactcttccttcaaaaacacagcagctagaatcgcaccgataatgacggataatgcacctaatggtgtcaccataatagctggagcaaaagtataagcagcaaagttcgctacttcaccgacaaccatcaaggacatcccgccccaccatatagggtttctcaagtagttgaagcctgcaccttggaaattgttctcttcactggcagcatttaatcccaatttagtaaagatgaatgatgtaccaatagctaaagaagacgtaattgccaaaaacaaaccaatatatttatcttccatggttagtgggtttacaatttgctctacttcaatgtccgcaagccttgcaatccttcgtaacttgcccttttccattacttgatctacatgttacttaaaataaagaatcgcgaatgtgaacggtttttcatgttgacagattgttgttatcatgatcaatatatagagcataagatgaagatcctatgaatcaaagtaatattgagtatgtcgtgtattgatacataggaaggcattgatatttattgtatatatacatttgtttcctttttcataacgataagagtctagtattcccgttgatgtatgaaacagcaaaagcagtgctctcgttgttccaggctatgttggttacttgaagtccgtcttgatctatttgatattctccatacgtagagatgggtaccgattgttgctgtacagaattctggtcgtacgattcaaggaacgtcttcacgtcaaacactatggcagatccttgtaaagtccccacagtcagccagtttctatcaggtgaaagactagcttcgaatatcggttctgaatcaagagatgcctctgccactatggaattcttagatatcgaccataccttcactgtgccatcgtacgccgtacttattattaaatcatcgttgatccaatgtgctgatgaaatggtcttcgtgtgatctgtgaaatcgtttgcagcactagagttcccacccctccatactttgatcgtattgtcgtctgaagcactgagcaacgatttgttggatttgttgaattctaaagttgtgattgttgatgtgtgtcccagtagtcttcctaatggtttgttatttccgatagtatacacgagtaaacttccacctgggcctggaatgacaaatttatctgtttcgacccattccaaatcaatacctaacgagtcttcattttcaatgtcgccttctttaaatgagaaatgttgtaattgggtgcccgttagggtactccatagaattaccacgttggatacatccgttgttaacaaatgggtgcaatcttggttccacttcatagcaacaatcggggacctatgactatccaagatgttttttagttttccctgtttattccatagcctcaattccccagatgtggtacctgttaacactaactcaccgtcaggagaccacgaaacagatattattggttcttcctcggaacgtttagggtatacaagatctattggatccttaattgaccaggactctttatctgtaactatatcaatggaccctatccgtgcctgagattgagcacctccccatactagtaaaataccgtattttgggttccattgcgaagtgaaactctgtgataaagttaaatggtccgagagtgttttgataaatcttgatgatgctgattgtgttcccgaagggctgtccgctgccatggctgcagcctgttcttgttccttcttctcgagcatctcagcttcaacgtcattctcaagtgcaaatctaccccgtgctgcaatctcggggaacttttgcttgtcgacttccaaagcttgaactaatgtaaagtttcgtttgtacaattcctgatctacaggaaccatctcgccgttcggtggcactagaaactcactttcagtgtatagtatacccttctgaacaagttgtaccaaacatcccagaggtatatgctctttgaaccgttcttcaaactcaagaactcgagtttcttcttgcaatgcaagtgctgaaacttcatgtccggcttcttgtaaatacctccaaataaggtaattgagctcttcactagctatcgacattgcaataaaacaaatctagaatatcgtagcaagtctccagctacctttctcctactgatacaaccacaaaccgccggactgatagcgttgcgttttcctgttttgttgtctttcaattgtttgtttgtttgattacttcaatttcgatatttagttattgaaaaatcgtttaatatcgcttcaatgaaagcatcaacaagtctgttaacatgacaaacaagggaataagctcgtaatatagggcgcattgacagctactattgtgtgaaccaggttaaagaattgttatttaattgtttgacttctttagcagacgaattattgctcaaatactgcagatatcaattcgccagcaagccgatttctgtttattttagtacaagtatcaccgtgttaaggggcagataacaacgggatcaattaaatcatggtcgacttctctttgaagaagcatggtgtttctagttggggccgtggttccttatcaaggaaggaaagcagtgccggtgattcttcatctacgttcaaatcgagtaggtatcaagatatgaaggtttctgatccagaattacctaaggtgagtgctaaggagagaagtaaagcagggactatgatgaagcgtcgtttatcagttcaccagtctaacaattttggtgctgttaaaatggatttcgataatatgcctgctttaccttcttctgcagctgactattcgtttgcctccaacgtcggtaatgcaacgcaaactagcctgataacagaagatcagcttcctgaccgtaatacatcacttgcaagcctgaacaccaacacccgtcgtccagatcaggagctatattcaagcaaatctttgaggcaaatactttcgaatccagattttaaagccaaaaagttcattacagagaagctaggtgatgctactgctgttgatatcgatcaattcacttctaatctaaatgatttatccttagaaattcaagatgagatcaagtttaacatagataagtctttcaaagagatattaatcgttaataaagggttggaaacagcaacaacggaattgaaagttctaaggacaaaagtacaagaaatgaaggatataatgaaccagttcgtgaccatcgcagagaagaagttgcaagctgaacaggctgccaatgagactgcagatttgaacaggacatcaagttcggctagtctctcaaatcattctttacttccaccactgaaaccaactccgtccgcaacaagaaaggatagaacatcagtttacatcctggaaaggatgtggaatgaggaattaatgacattgttcaagaacgtcgacggtgctcacaaatatataaccagtacaccgggacggcatatcctgttggaaagcgacaactggattgaaatcaacccagctacgcttaaaccattacaaaaagtacgtttattcattttgaatgacgttgtgttgattgcggctccaaaaccatcgaagcagacagaactaactgtcagtagattttctcctttgagagatgtaacagtggaagtgcaatccgaacatgagctttccttcaatttctctaacaagcagcatactctttatagacatagagaccctcaagtgttttcgaaagtgatagatatcatcagacaggctaaggatgcgttacgcgagatttcgcaggcagaagaggatacaacaagaaagattcgcaactcctatacgctgctccaacaagaaagaactccaaacagagatgccactacctctcctgtcaaagttcacggcagacaaagatcatatggtggtacaggtaccccaagcagacacagatcagacgcacaaaatgatgcattgttgacaaatatcacaaggtctatacatgtaagaatgggctctgaagagactacagaagtaacaaaaagacttaaacgcctcgacgatgcacttgaagatcttgatctcgagatcggtagacaaaattttgatctcgccatcacaaaactcaatcacatccaatcatcactaaagtcattatacagcagcgctaccttcgatgaatctgttatggtggaactcctctcattgaaatgttcacagaggaaaaccatcctatacaccaaattgacaaatctattagcctgcgaaactagcgacatgaccaaattgaaaagttatatgctaaacttggtagctcttaacgagccagtggacgctctagaagtgttcctccagaacagatcaaacttcatcaacgatttaaccctacaaatcggtatcattgataatgtaactagtttcattacccaagtagcgatcatccggttccaaaccttgaagaaagtgactcagcagtacttggaagtatcaaaaaatttgaaacgtgattatacatcactacttgtatgctggtgcagcgaagaagtggataagcacttccagctcatggaaagagaactatcgaattcatctacattgtccgtacaagcaatcaagataactagaaagcagatagatgaactcaaacctgtcgggatggactacgtttacaaactcgatgacttcattaggagaaacaataacaggattctataacgtaatatctatgtgtatatttagttaatcaatcggcatacattgattcggcatatctatcagatgaagtacaacatagttttatcatctttagctttgtttctttctgtccgttactcgtgattgtaccggaatgttctagttgataattattttcacagtaacattggagctttaaataccaagatttaaccaggagttacatacctcatcgcgacaccaattctccactaaagagctggattctgtaattcaaggtagtgataactatagtaaagctgtcaataattgcttcggatagctgataagaaaactcgcaaatcagtgatataggagttgtattatggaaaagcttttacattggtcaattgctaacgcacaaggagacgacgaagctaaggctagggctggtcagccagaccctaaactattggaacagctatttggtggtggtccagacgagcctactttgatgaaacatgcaatggccgtgatatccaatccagaagctactttagagaacaaattagttgcatttgacaacttcgaaatgttgattgagaatttggacaacgcgaacaacattgagaacatgaaattgtgggaaccattgattactgttttggatgaccctgaacctgaattgcgggcctttgcattgtctgtcactggtactgctgttcagaataatgatcagtcgcaaaataactttgccaagtacgatggagcactagcaaaagtgataaaactagcatcaggccgtgcagaagacgcgcaagtgagaactaaggccttctataccttatctaacttgatcagacacaataagttgatatatgatcagttcaaccagttgaatggtcttcagatcattgcgccagtcttgaaggatgctaatgcaagcgaaaaattaaagttaagagcgatggcacttttatcgactgtcttgactgttgctgatatgaacgcagatttctttgctctactgcgagcttacaatatcattgagacgactctagagttcttgcatcctgagtgtaacttatatttgatcgacagagtactcaacttcttctcacaacttatcaatgtcggttttgagttctctgctacagaacttgagaagcttaaggttggggtgaagaacattgaacccgtagaagctcaattgaatgaagatgattacaaaactgttcagtatgtatctaagtgatctaatagcaccctaaaagataatttctttctgttttacattaactaactaaggcttaccattattttatttatagcactttcaactaccacctaggccacaagagagcgaaatattgatgccttcaaatgaataaacgattcaatccgtgaatatcaactcatttgggtcatcagatgtgtatagagtatgcaaagccctctcaagagatttaggcattagaggcttattgtcatgactttgggcgacatatcccgccttcatatcattcatcatagactggaaagacttgtaatgcgtaacaactctctttgcctttggttcgttcacatgggcaacttgttgaaggaaactgtacaacacgtcagttggagattttccactcttcacatttaaatgagaccactctttatactttactgaaacgtcgtaacgcatcttacccactacccacacaagatttttcatccaatgagaaaattcattcaagttttctatagggaacacatcaacgtttgcatatattgtaacctcgtttatgattctgtctaaatttttggactttatgtttagttctctcatctttgtttcttgtgtagatcttcgtctcgtctttgattggctttgacttgatgcgcttcctgacagttgttctaatacccgatcctcatgttgtctattctccatattgcataacttctttcttaaagcatttagtccatacattactacgatgaccttcataccattttttgagaactgtcgaatttcatcccatagacctctcttatcagtcctgtatctgtgaaagaatggtaatgcctcatacaccaacacacatatcgactcatttgcaatcacctcatcgcagggatagaatacgccgtgagtctgatcataaatagatctacacttacgcttgaatctgatgataggaaactcctcataattttgtataattgtcaaaggtttgagttcttcttcaaacgatatatgtttagaatgtatgagttccataactttattattaacggttaatatcatttcattgtaaatagtctcctccgttctagaaactttgttgcattcattgtagagctttctcatttctgatgtacctaagcacttcttgaccatctcggagtactcttgatctgtaaaaggtcttgcgtttaccattggtttgaccttatcaattttctcatcttcaacgtgtctaggttgtcgcagggccaacttatttgaactgacaggtgtagattgagaagagtgttgtacaaataaaggcttttcttgtcgtgtattagttatatcatcgtcttcatctgattcaattacaatagaatcgtgttcataattagattcgctatgatagctgttagttttggtatccaatgatctttgttgtctaatgtgtgtatcagagactagagttccatacaaatcatggcaatcctccatatacttagtaagatccaacgcaacacttgaaacatccgccgtggctttgttctgtggttttttgagctttctcgtaaggtatggatcaaacttcggaggttgtacttcgcgatatgatcttttattggcaactgtcgttgataactgtaagggtgacttgactggtaaggttgatctagacgaaggtgacttattaggtgttggagatgacgctagttggtagttgaatacctgggacatcttctccaatggagaagactgaggtaacggtatgatatacttgccagatttcacttcgctttcaatattcttgtgtattactgaccgctgatttgaaacaagtggagaagcttcctcgtcatcacttaatgctgatattgataagccactattctcaatttcatctaaaagacgagattgggatcttttaaaagtttgagtctgaggctgagaagccggctcattgtccgattctatcgcggtatcattttggaatctgccctccacttctaaggaaaagctgacactcacactattctcaagcagcaccacgtcatcatcctctacattacgttgtcccaccgaatcgctgagtgacctagccaaagagtaatggattggatccgaagctggcggtccttctctttccccttctgatgaaattagtaccacaacaccgttcgcagttccttcattacccactaaagactgctctgtagtatcattgatatcaatgatattcacttcatccatttgactatcagtataaccaaggggcagttgtctatttctatcctatgttaatgattcagttattgtttggcttcgagagctctgtttacctttttaatggattttaactggttttcaaagaaggtttcgcgtaagtgatgagtctaatctgatagtatgatacaacgagatataaccagatatagcctcagtttttatgtagcatttaaatgtagttcgagggaatgtgcgactactaaccatttgaatagttacttgtttttgtatcacatgaagtatttatgatctattagtttatacatattatatcgttatgatgaagccatttgatctattttcttaatagcatcttctaaacgtttacttgctgacattgatatcgcacgttggttagtactgctttttcttttcatctgtctctgtaactcctcgctgaacaccaatctgaatgcacttttgagatcatctggactgagtccgttcagttcatgtttttggaaagattcaagaactgagtcctcatccatagagcagatactgaaaaatgtgatggattttgacaaatcttcggtatcattcccatctgttgcacttttgcacgcttgttgtaaagcattcacgttccttagtaatttttttgcaccgtgcacgtttaataccgaaatcgactttgatcctgagatcaatgcgtgattcatgaagtttgaaatcccaataaaaacgagtaaactatgatcctcagcaaatgatgttcttagcttgttttccaagaaagaaaggtctgaaactaatgaactgatattctcgtccaattcgatggatgtaacttcagggttccaccttgatgagtgcaacatgcagttgatgtaatacaagcagcgaacacgtacatcgtatctgacactttgtagtagtaaataatgcaaattggtgaatttttgtgtgacagcttcaaattcctctaggttatcagctgccaataaaaatctcgttgtaccacctttatcagtaagatccgcttctgagacttcgaaaaacgaccacatactacgtaattctgcattattagcttgcttccgcttgtccgatgattctgatacattgtcagtatctttaacttcttttttaataccaggtaaccacgatgagatccattcaagagtagtggcaaaatacactaaggtatctattgtagagtcactaaagtgatccgttttttccaaagagcgcctttcctgaaataccctaggacactggtttagtaaccgcagagtttcggcatctataaattcgtcatcattggcgaatattttgctagtaatgtctccggatgctttatcagttaaccatgacgaaacgagttttttactgacaaccgtgttttgtgttccacaaatcgactggtaaatactgtaataataactgtaaaacttatcagcaatggaaaccaacatgtgagcgacgtttcttctataaaagtttcctgcattcgtggtttgtaaaagtttaaagtataacattttaaaatcgattgcacttttgaatataggtgtaccgttgaacaatgtttcgactgcaaaaggactattagattcaacttgagattcatataaaaagttcattgtctggttaagttgaggcaaaaactcgacttccataacattcaaaaagaaagccgttgatgatgttgtggtgtcttctaaagaaggtggtaataagtcttttgatccttgaacaaataccaagagggattctaatatcattctcatgttgaaaactgttggtggaacaagggtatcctcatcctcgaaacgttcctctgctaggtatatattttccaaatcaacattggtagaaagtgcgaagccagggaacatgtcagtaagcatagctttcaattcgtttgcatggcccagttggctactgttatccttactgatgttattttgtaaagagaatagttgggtttcagttgaagtttttgcttgcaatagattactggaagttctgtgtttatgtcttctgtctttcgttatggaaatatcttttgtgtacattgctataagatctttgattgtccgtaggcaggtttcccatatttcaacgaatggatatgatacgtttgatgtggcaggtggctggagagcttttgttgtctcatacaatacacgatgcccttggattgcagtcaagaatttgataaaaatctcccaaaacaatctacgtattagaacacatagtatgtcttggccagagagtccaagagtagagctgttttgtaacgataccgtcattttcaaaagtgatgggtgtttgagacgcatatcttcgacagatttagtgattatgtttttaatttcattcttacttcttttttgtaacagatcaattgccagtgacaatttgttcattgcatttaacgttttcatatatgtgtacattttgtcgtaatcagtctcctcagtgacagcgaattcatcatcttcggagtatacctgtcccaatttctttagaaagtctagaagaagttgattctttcggtatgactcttcgctgatatcctcgtgaataacatgatgtaaatagttttctaaactgccaaacgtatcttcattatttgttttggcgaacatgttttgatcatcagttttatgagaagcttgttttgagtaaacaatctcagtgataccttccaacaatagttcgaataacgaatgttcatggctgataaattgttccttcacaggttttaaaacatctaactgccatagatcatgctctttagctaaggtgaaaccgagattaagagcctcttgcgcctgagtgaaatcagaattgagcaaagattgttccactttttgattgagcttaatgacttcctccattgcagataaagtgctgatcatcctagattgtttcataaaatcttcatttaaatcattcaaagtttcgtcattaattgaaagtttctgcaaagaattattcacaccgttcttaatatcagccaaagtatcttgtgcatctgtaatacaatacactgttttcgaaaaggatgctatactatcgttgaatgcctggtaatggtcgtttgcaacctcttgtaaatccttagcaaatctcgatttcaattcaataaattcatcgaaacggtggtgcaaaccaacagaagtttcatctaaaaacctcaatgcaagctcaagagggtttgtatccttattaataatcctattccattccgttcccaacaatgctatgtcagcttgcaacttagcgactgaattctccatggcctctttttccgcttccgtagtgcttcgaatagacagcgcacgctgtctattcctcgtaacaggttgtaaatgatccatcgccttctggatacgtggaaaatgctcccttaattatatatagttcctactccagctcaactgattttgcggacttttactgttttgatgtgctcagattgtttacatgtaatcgactttaaacttactaactcaattttataaaattcaatatcaagtaactgatacataaaggggaaaaagtactattatgattcacaagcctggacaagctacttggctttgaaagcttgggatggaaccttataaattaagttacagcggttttgcattgccttaaaacatgctgttattgtatagttacatatgggtgtttttctgaagagttaaattagaagaatgcggtatccaaatcgccgaacccgtcatcaaatccgttttgaaacggttcttccccgaacacgttatccaataggtttggatcattaggatcaaccactatttgttgctgttcaacttcgtcctgtttcgttggcacggcaaggtcttcgggaatcggttcaacagaaagagccatttgttcttgtctcttccgctcttcttcctgttccttagctctacgttcttgctctttccgttcagccaagatcttcttgtgcctttcccagtaatctggaggagcatgtgtcctgttaggcgcaagatgtgaaaacttgtttctatgtatcacgatattactgggcttcacttgtatcttgaatttatcactatactctttctccgcacggtctacgacatccttatcgtatatatgatcagctagctgatcgatccatttgttatagaacgctgttgcgtcatccggcacctttacagctgaaatcttatcctgtgacgttactcgaagttcttctactatcgctttttgtttctgaagatgttctgtcatcaattccagagtccctgcagagactatttcgggcggtacaatcttatcgagcggtatcggttgagttgttagcatatcgataagcctgctggtaagcatgaactcattcgttaaactgtgcctgaacgatatcacgtcactttcatcgtgtaaaatggaaccaacattagtcgcttgaactctcgccataccagaagaaccttttctcccttgagagaaccgctgatttgcagcatgtccttgcgcatggtcctggtggctctgtctaagaaccttcttattcttccgtttcctacctggaacacccattcttcgacaaacccagtatattcaaactaaactaggggaaaaccaaaaaattccagtttaattaatctcgttcagtggtccagcaaatataactaggtacttcctggttctttttagtcgattgttcctcgtgcattaacagtgtttaattgttccgtaaggttgttgacgtttggaaaatcaatgattatcaccagatccgggtaacacattacttctcacacactgctcgaaagattaaacggtagatggctgcaataacgcagtttactcatagataaggaacaagtgcttagttgtgtccatcgagtcttgttctagtggtatttggctaaacaaatatagatattaagcaaacagttatgcctggtttgatagttccgttcaaacaagtggacgttttcagttggacaccttttaaaggtaatcctgtcgcagtgattaatttgattgataaggaagaaacaagtgtgagtgatgaacaattacaggcaattgccacatggacgaacttgtctgaaacgactttcctttttaaaccttctgcaggcagtagtgctgattataagttaaggatcttcacaccagctggagagttaccttttgccgggcatcctaccgtgggatcatgccaagcgttcattgaattcaccaattgcactaagaagagtttgaacaagagtgtcctgctggtatagtgccattgacagtttatggtgataattttgttagttttgaagcgattcgtaccgacttgattgaactttcagatgaccaagttgagtcatacaaggccaaggcgttccctggtcttgaactcattgcaagacccaagttactcgatgtaggccccaaatgggtcgtcgtcttggcgaaggataataagacctgttacgatgcggatctggatttacctgccttggctgcactaagtatagagttcggtcacaccggcatcattctcggtggtcaggatccttcagacgccagcaagtacgaaatgagagcatttgcgccgagcgagggtttatctgaagatcctgtatgtggcagtggatctgtggcgttggctaggtatttgcaggaccatcacgactacgctgaatcattctcatttaccatttctcaaggtggaagactcaacagaaagggaagaatctttgttcaagtcgagcactcttctgacggcaaaattaagtatatcgttggtggtaaagccacaaccttagtgacaggtaccatcgctgtctaaatagactttcaagtacacgatatgtaactgacatctctctctttctctcttcatggtgtctgtcattcatgcgggtaatctcgatatgtgccgaattaaggctgcaaagtcattattgcaaagaattggaagtcaatagagtgcttgttgccgaaataaaggtttgtgtaccttacgttagctcctattcattgctgttgtattaagtataggtttcgttgaccggtatatagggactgtttcaaagtaacagatttatacgatagggttttcccctttaacgtaacatacggaaggcatataaactggattgaggatgtctgattttgctcgagacgaagagacagatgcagctgagtttcggttacaactttctaaaccgcatgaacatcgtaggagaagttttctggtcactgcatgtttatcgttaagtactgtgctgttctctgcttatcttttcataagcattatctcttctttaaagggatctgggacattgaacaacggtagtggtcccagattgcctaacaaacaaatagattacacgaaagatggtttgttaaaagtatcttttgcaaacgtcaggaacaggacgtttcaacctgaggtaaaaccattgcaatggattagcactccagattcacacaaaaatgataaggggttgtatgttacctttgaaaatgacacatactcagtacgttcagtactcgatgaaagttactccaagacattatttgaaggtacctcattcacttacgacagtaaaaactacacagttgatgctgtggttgcgtcccccgagctaagcaaagtgttgatcagatcagagacagaaaaaggttggagacattctacatttggtacgtattttgtttatgaaaacgatagtttccacaagattgattccgagatctcaattgctaaatggtcacccaattctagggatatcgtgtatgtgaaaggaaatgatatatatctatactcttcggattcacatgagacatcgaaaagaatcacaaatgacggaagcgagttggtcttcaacggtaagcctgattgggtttatgaggaagaggtattagaaggagacaccgcgctatggtggtctccaacgggggactatttggctttctttaagataaatgaaactagtgtcgaggaatttcctattccatattttgtccaagagaatcaaacaaattctgcttatcctgagctacggaagattaaatacccgaagagtggatcgtcaaatcctatcaataagcttaacatttatgatctgtcagctgacaaagtctctcaaattgattctacgagtgatgattcgctcatcactgaagtcacatgggtcggaaaccatgaaattattgcaaaagtttcagatcgttcttcagacattttgaccgtcatcatggtagatgccgcggatggatcgcgtagtgaagtgtctcgaatagaagaaagcgatggtgggtggtgggagatcactcacaagaccacttttgttcctaaagataagtcaagatcaagatcatataatggttacattgacttggtaccggttgatggctacaatcatctcgtatactttacaacaaacgtaaccacagagattccaagtgttgtcttaacctcaggtgaatgggaagtcgtggatggaccagctgctttcgatgaagagttcaacaatgtatatttcattgctactaaaaagtcatcgacggaaagacatttatattacgtcaatttagaaaggccacagaaggtttatgctgttaccgatgaaaggttaaatgggtactattctgcttctttctcagcaggcgcaagattcttgctattgaactacttaggaccagatgtcccttatcaaaagataattgatttaaagtcagacactaaagataagaatattcgaggaaatatcatcggcaagactttatactaccttgaaaaaaatgaaaagctacataattctttgaaacgatatgccatcccagctagaattttccgtgaattgactctgggtaaagaccaaaacggttctgatattatcgtgaactcttacgaaatattacctaatgatttcgacccttccttaaagaaccattaccccgtattcttcttcgcctatggtggtccaaactcacaacaagtagcgcaaacatttggtatcggattcaatcaagtaatagcaagtcaattggatgctattgttgtcgtagttgatggccgaggtacaggatttaagggtaaagaattccggtctatcgttcgtggtaacttaggtgacgtggaatccactgatcaaatcctcgcggcaaaattgtacggccaaaattcatacgtgaacaaagaaaagatctcgttgttcggatggtcatatggaggttatttaactttgaaaacgttagaaaaggacgcaggaaaacatttcaaatacggagtttctgttgctcccgtcaccgattggctactatatgactctgtgtacaccgaaagatacatgcacacaccccaaaagaatccagaggggtacgataaatgtaaagtacacaatgcaaccgcgtttgcgactgtaccaaggttcctcttgatgcatggtactgctgacgacaacgttcatttccaaaattcattgaagtatttggatctcctaaacttgaacaatatcgaaaattacgacgtccacgtattcccagattctgatcacagtattcagtaccacaacgcaaacgtcatcgtattcaataagatcttgaattggattagacatgcctataatggggatttccttctgtaagtacacaacatcactactaaagtgaacttaaataacggtactaaagcaaaaagaataattttaaataatatgagaagcactgcctgtttccagacgattcaatgggaaactattgagcatagtctgacgccatgttggtagctgtcatcacttcaattgatgctattcttgaatattaaatatgcgggtaacttcatatccgttcacaatgatttctctattgggtggcaaaatctttggttttaaggttcagtttgatatttaagcatatagtagctataacgagacatttgataaacaatcctacttgtaaaggctaaggaaaatcgaagacgataaattgattggttctgatattggtgagtaccggtaattgtatttgaaaatatttttagaatttcattataccgttggattctagtattgactgatgacgaaagataacgatatcgtaaaggaagccgctgctccaggcgccgaagagaagccaattactgtaccagatgaacaaaacaataagaaaaaggatgccaacaatgaagaagagctttctgaagaagatttgaagcttaaggatgatttggagttcttagtcagtacattgaagggagatgatacctcattgtatttgggatctttggatcaattgaaagattctatcaagaattcaaccagttctatgactgctgttcctaagccattaaagtttttgcgtccttcgtatccagaattggtttcagtttatgagtcttggactgatgataagttacaatctcttttggcagatgtgttgtcagttttgagtatgacttactccgatgatggcaaatacgattcgttgaaatatagacttttatccaatgaaaagaacattgagagttggggtcatgaatacatgcgtcatttggcattagagattggagacgtgtataataaacaggtggagaaggaggcagatgagtctaccccggaaccagacgcagatttcaaccaacaagatttggttagtttatctcttcaaatagtgccatattttttgaaacacaatggtgaagcagatgcagtagatttgttgttagaaattgaatccattgataaactaccacagttcgtcgatgatacgagtttcactcgtgtgtgtcagtatatggtcgcgtgtgtgccacttttagcacatccagatgatgtttcatttttacaaacttcattcgctatttacttatcgcacaacgaattgacagaagccttgaacttagctataaggatcggggatgaaaatttggtaaggtcagtgtttgatgcaaccgcagaccctgtcattcacaaacaattagcatacatcctttcaagtcaaagatcttcattccaacaggaaggtgtgcaagatattatagacaacgttcaattgtcggaacatttcagatatttagctaaagaattgaaccttctacagccaaagacaccggaagatatttacaaatcacatttagaaagttcaaaggcgtctttcaataagacgagtatgagttcagctcaacagaatttggcagaatttatggtgaatggttggttgaatttgggttattcttcggacagcatctactccaaagacagcaattgtgtttataagactaaaggtgacggtatgacctcggcggtagcgagtatcgggtctatttatcaatggaacctcgatggtttgcaagaactagacaagtacctagtaactgaagacttagaagtcaaagccggtgctctcttgggtataggaatctctacatgtggtgttcatgacggtgaagttgagcccgcacttcttctcttacaagagtacgtcacaaatccaaatgtcaagctaagttcggctgccattatgggattaggtatagcatttgccggtagtaacaatgatgaattattgggcacattattgcccgttgccgctgataccagtcttccaatcgaagtatgttccatggcttgtttgtcattagctcatgcctttgttggaacctgtaacggtgatatcacaacaactattatggacaactttttagaacgttcctccgaagaattaaagacacactacactaactttttcgcactagccttgggtatcttatacatgggtcaaggtgaacaagtggaggatgtcttggatactatttctgctattgaaaatccaatcacgtctgctattgaagtcttagtgaatgcatgtgcttacactggcactggtgatgtattgatgatccaagatttacttcaccgtctaacaccaaagaaggattctaaggacgacaaggaagaagaagcggacgaagaaatgggtgatgtgcttccaagtgagattcaagacagtttaggactgggattacaagatattccgggagcagctgataccgtgtataatgaacaagatgaacaaccagaagaggttgatgtagtaatggatgatgcagatggttccaacgctacgaatgatgaaacaaaggcatccgagcaaaagggcgatgaagacgcagaggacgaacaagagggagaaaaagaagaaaacgctgaggatgctggtgaagacaaagagaatgaaaattcacaagctgcagaactagcgtttgctgttttaggtatagccatgatcgctatgggtgaagaaattggtaaagaaatgtcgctacgtcactttggccatttgatgcattacggttctgatgaaatccgccgttcggtgcctttagctatgggtttgattagcgtctctgatcctcaaatgaaggtgttcgatacactatccaggttctctcatgacgctgatctagctgtgtctatgagttcaatcttctccatgggtctctgtggtgcaggtacgaacaatgctagattagcacaattgttgagacaattggctagttattattctaaggaatccgatgccttattcatgacaagactctcccaagggcttgtccatctcggtaagggaaccctttcattagacatcttcaacgatgctcaggttttaaataaggtatcattggcatccttgcttaccgtattagtcggaatgatgtctcctgagtttatgctgaagaaccacagcctattctattatctaaattcggcaacaagaccaaaatatatcgttactttggatgaagaggggaacccaatcaaggccagtgttcgtgtcggtcaagctgttgacactgttggtcaagcaggtaaaccaaagactatcacaggttggattacccattctacaccagttctactagggcacggtgaaagagcagaattagaaacaaatgaatatatcagttacaccagccggatcgaaggtgtagtgatcctaaaaaagaatcctaaatacacagaagaagtgaactagacacacctatacgtaactaaataaaaagaaccacgaaaaatcatttctacaaaacaagtaggaaaccattggttttttaggtgatgactcggtcgtcttagactttgttttcttttctttaatgatatacattcattatatatttaacttgcttttatttgtttattgtacgacatctgccgaacctctatgatggaacaagcattcaagttctgcggattcaaagaatttatcacgtccgtgaaatccttacttggtgtaaattctgaattatagccctctctattggaattcaaccgctttacctgccatcaataatccgacaatcaatcccaataatccaagtacagaaccaaaaatttcaataaccaagatcttaacgaaaagagacgagtctgcagcatctgatatagctgcagtggcaccagtgatacccacagccacaccacaaatcaaattcgaaacaccaacggtaatcccagcccagaatatcgagtacccggtgtatagattggacttatcgaacatcgtcgcagaattggcaacggttaccttggaagaaaacacaatggccataattagcccgtagatagccaccacttcacagaaaatgatcgaaatcaagttcttggtagtgattcttggtgcacgcacaccagcaccaataattgaagaaccagtgatgaaaataccccaagcagctcccaccaccgaaagacctatgcacaaagcgatccctagattcgcccacatataaggagaagtcttcatcaagaacttaccaaaatttatatcctcaccatgattggtaaatagcttgtaaagaacgtataccaagataactgttattatcgtgtaattgattgcactcttggtatactgccatgcagctcttgaagatgatccagtcttagacatcttaaacaaaaaaatttctacaagtgtactatgcgtcaatgcttgaacccacttgataaagctgtaacccctgcagccgaggaacctctctgcttctaaaggtctcatggttcgcttccaattctatatagctttacttaatttttttatattgggaaccagcggtcccctataagaaatgtgttcggtttatagtgtggtgttagggtgttgataagtacatcatatgagtatggcatgatgcacgtagatgaagcgttcttacgaccttacatctggtgtagtgtatctattacgacgttatatgtacatagaaaggtttgtcccagtatgatggagccttctcattctttttttctctatttatctttcattgttgtcatttatgttagtgattaaaactaagctgaggaagagtgcatcacttgggcaccgtcagtggccagatctagtagtctccatgtgcaagtgactttgttctttgagaatctgttgataatttccagggcaatgttctcgaagttttcagtggctagagccaaaatagttgggccagcaccggatagacaaatacctaacaaaccgggatgggtttttggagtgacactggataagatatcggtcaaacctgggatcaaagtctttctgtatggctggtgtactctgtcctgcatggcaggatagatcaagtctgggttaggaggatctagcgtcaatgcagtggtcaagacagccagtctttgtaaattgaaaaccaaatctttagtggtgtaagcctgaggtaacacaccacgggaatccgaagtggacaactcgaagtccgggataatggcaatacatttaatcttattgttccagttatatttcacatgacgaccgatatcggttggtggtaaaggtggtaccaaaccggtatcctcaccaccacttggttcaggcaacacctcggccaatgggatctctcttctctcgacttcttgaggagtcaaatcacgcaagaacgatcctacgaatccacccatcatcgcagcggtaatgttgtctgggtgacgctcgatcatcaaacagtaatctaacattctttgctttgggaagttcaattgccccacttcgttagccaacattacaccggcaacaacagccgcacctgatgaacctagaccacgtcctaatgggatagggttgttaactaaaatctgagtgcctgatgggaacgtacggatcccgctgcaacgtagcacgtacaaggcggttcttgtaattaaattctcatcagatgccaatggtactgtcgaatacccgtcactttctggtgtgtacgataacttacagttgtttctgtcatcgttggtcaaagcagcgttcttcgaatcgatgttcacttctagagttaaaaacaacgccaacccgatacctaaaacgtcgtatccgggaccaatgttagcactggatgctggtacgctaattttaaaggaacgacccattttgtattctttgttgtaactttcaacccagtttatttaactgataaccaacttgcagcgttgaaaagtagatttccagattgctcttgaaaatctttatcgtaatctaaaactacagatctattactcaaggtataacggtctttaaatacacgattgttctactcatgtggtgttcaaaaacctctgatatgcagatcgcgatgcgactgaaactttttttcaaaatttcgaagccattgagtcagaggttacccggggtaatgcagctcataaggtttatctcactgtcatagatatagtaatttaccatagattaaggtaagtgttccatcagttctttcagttattttaactggttctatattttactaatcagtgccatttctatgtcccccatggatcattttggtttctaatgacgtctcttctcatgtcttttatctctcaactgatcaaattacgtcaaaaatctttcaaacttgaagctttctttgactattaaattatatagatagtatagacaatagttctggttttaacagcatgttcaaccactattttccagccataattgtaccagtgatttgtgccaggatataacatatcaatatcatgttcaggctcggaagaaactccaccgttggtagattagccagagggaaatggtactcgcaaattagtaaaaatgctgagaattcacaggtcactactttggataacggtgtgaaagttgctacttcaaatgttcctggacacttttcagctctgggtttatacgttaatgcaggatcacggtttgaggataagaatttgaaaggatgtacccatattatggaccgtttggcattcaaatctactgatcatatttccggaagagacatgacagagacgttagaactcttgggggacaactatcaatgttcttcatctagggaaacgatgatgtatcaatcgtcagttttcaatcctgatgtggaaaagatgttccatttgatgtcggagactgtgaggtatccgaggatcacagaggaagaattagaagaacagaagactaccgcgttatatgagatcgatggtgtttggcagaaacatgatttgatcttacctgagctattgcatcagacggcatactctggtgagactcttggatcccctttattgtgtccaaaagaattgatcccgtctatctccaaatattacttgaccgattatagaaacaagttctacaacccagagaacatcgttgcagcattcgttagtgttcctcacgatgacgccgttcaattgacagagaaatactttggtgatatgaagagtaaatacccgcccgttactaagaaaccagcgaagtatacaggcggtgagtattgcattcctccgggtcctgtcttcggaggattacccgagttatatcatatgcaattagccttcgaagggctacctatagatcatccagatatttatgcgttggctactttacaaactcttctaggtggtggtggatcgttcagtgccgggggtccaggtaagggaatgtactctaggctgtatacgcacgttttgaaccaatactattacgtggaaaattgtgtttcattcaaccattcctacagcgattcaggtctattcggtgtatctatttcgtgtataccacaagctgctccattcgctgccgaaattattgcacaaactttatcgaatgtgtttgccaacgacaaactgaagttgacgaaggaagaagtgtcaagatcaaagaaccaactaaaatcatctttgttgatgaatctagaatctaaaatcgtagaacttgaagatttgggaagacaagtgttattgcatggtcgtaagataccaatgaaagaaatgatggaaaatatcgaaaagcttaccgtcgatgacattaaacgtgttgctgaaacggttttcacaggcaaagtcaataatcctggtaatggtaacgggaaggtgacggttgtaatgcaaggtgaaagagaatcctttggtgatattgaaacagtattaagattctatggtctaggtaactacccaaaactagacgtaccaaagatgaagaaacagggttggttttaattctcaattcagcattcattaattattattataacatcaaataaagatatgtaaatagctaacataaaggacaacaaaaatatcaacagttcaatgctgtgcacacgaaatcaatgaaaaactatgtttctataacatttaaatgaagacaccatctgtagattgagctaaggattgtcttctttcagaaagtttctcgtatctttgcttccaggatgatatttccttctcaagttcagatatctgttcttgatagtaagtgttatctctatgcattttattcagtgttgcatccttagtagcattgatggcctctatttctcccaatttttcatcgagattaccaatagtttcctcgtattgtgatttagcatcgttggctatctcgattacattggcttgttcttcattcttcctctctaactcttcaattattctctcaagtttcttggacttcttgatttcctcgaacttggaagtacgttcttcttctagagtagttgttagagtttgaactttattgaaccatgcgtcattctcagaagtgtcagctagtttattcttcgcatccaaaagatcgttcctcaaaatctcattggcttttgctagagaagcattttcttggaatagatttgcattcttatctttttccgaagaaaatgttgtttttatcgtatccaattctgtttgcaattgatctatgagttcttcattacgttctgcttgttgtttttgcaaagctaaagattcctccaagaattgaacatcgtgcgaatacttttccttttcttttaaagactgggaaaagttcccatttgcttcatcgagtttagacctcaaaaatgtacgttcttcttggagttgtttgttttcagctgatagggattgtgtggtctcttctaaactcaaatttttcacctgcagagttttgatagttgtttcaagtgtcttcttggcagcttcagcttcatctttttgaatcccaagttctgtcacaagacgctcatagtgattggtctgtttcaataaatcttggatttttgcctccgaatcgagtttcaaagtctccagttgataaccgagacttgacatttcctttttcatttcagtttctaatctcaaataaccatctaacttgccttttaaacaatcaatttccactaagtattctttattattttctacggctcttgccctttccttgtaatgtgttatatcttcctctagtgctttgcttttagatattgatttatcaagttcgatcgttttctcgtcaagttgagattcaagttcagtaatttttgtttcctgctgccagatctcttgttctttctgtttgttctgagatctgagcttttgaatcatttgcgtcatactctcgatatctttttctgcttgctttaaaccatgcttgacagctctgacttcactttctacagtaaccaaatctctttgcgacccttcgtattgcgtctgataacgcttagagttagattgaatcatatttttctgttgttctactgttttcagttcatcatctaactgagctatttgttctctcaacgaagcttccgttaccaaactcttattgtaatctaacgtcaggtcgtgcagcttgttttgatattctaccagagaactgtgaagcctattagactctactctatgacgctgtagttcttcttcgtatttctcgaaggattcgcggtgtttgaaaatatcaccattaatgatgttcgtcttgtccctaaacggagagctgttttgtctcatctccagagatttaacgtaatcttcgtttgcctcatatcgcagtttaaagatatcagcagaagaatcagatcgttgtatttgtccaaccttttgatgaagcgcacttgcgaccctttcagcattttttctagcgttcatttcctttgtgagctgtctttttaagaagtcgatttccagaagcattttctcttggtttagttcaaacttatcaatattttcaagttcctcgtctaagttcacttcagataaagtagactttgaaagttgtttgatcttcttcaattgagcagtcaaagtttgattgtcaaaggaagcagaagctaaacgagtttctgcaaatctcaaacgagaaatcaaattcttcttttcctcaatttcactggtcaatctcatttcaacatctttatatttcatggaaagttcatcaaattctctccgtagatcgtctgtacctacagaagacgaaaatccattgacagctttaccagatctgccaacagacagcagacgctcattgaggaatttattcattgactgttcttgtagtaactctgtcttcaatttgtttagttcatggttgccattagaagatccattttcttgttttgccgctaacaattttgagtattcttcattgatggactccaatttacatttattagagtcattttcttgtctcactgcctttaattcctttgataacgataatacttgaattaatagtgattctttttctttggataatgaatttaccattgattcctgttccgaaactttaacattaacccggttgagctcagcagatttattctcaaataggctgttttttgtagcaatatcattttttaaagacttgacctgagcagcaagttgagtattctcttcaaaaaatcccttcattctgttacttgtagcagcaagatgcttttccaaagactttaactttacatcaatggctatttcggaatcgttaaccttggcttccatgtccttcaaagacatcgtcttctcttgaatctctttcttcaaatcactaatttccctaattaatttatctttttcggagtctaaagcacgctcgtcattctttacaacatccaacttattcttaagttcattgactgtaatctccagcttttctttatcatgggacaactctctaaacttatcttctgataaatcggaagcatttttcgtcttttctaattcaaggcgtaaattatcagcttctttagataattcgaggttttcagtttccaaagagtctttaattgacagagtttcatcccatttttgttgaatttgaatttgctttgtcttggtagcctcaagaagttcttgcgactgttgtagttcactagtttcttttaacaataatgctttaactttttctaactcttgttccaccagcctctttgcatctaccataaccgtcgtacttttttcgctctctgctagcttgttttcgagttgtttgacttgttcagctatttttttagttttcaagatggtattcgaagagtctaaaagcggtagcaatttcatgtataaattgtaccatggattttccatgagcctgtcataggtttcaaaagttacctttaagatccttgcagcctgtaatttcttaagatgacttctgatttctttcctgactgaattagcagatattatagcatttaacctagtaacagctgcactcaaacgctgttctttcagcagttcaaggtttgctaatacaccagctttgaaaaacagctttgtgttcccgaccttgtaaattgttggatccaggtgaagtgatgataacagtatttcacagttctttttggagttgttagtgaatctacactcatctgaaagaattttgtatctttggaaaaattccttgaagaatattctgttgggataaccatccctagcaattcttattccttcaagaacaccgttacaccgtaattgatctagaataagcttcttatcaaaatcacctgcctttttcttgttgtttggaattatacaacgaacgaaatggggatccgtattgccaagctgttcaatgagtgtatggagctgttccctatgtttgttagatgatgtcctaaaagaactgcctctaatgcgatctgcgaaaaattgtgataccagagggttcgcacaatcattgagtacctgcaataaattttcatttaaaggatctttattctttgatagccaatcagtaacgttgtattcaacatcacctgcataatgctttagtataaagcagttatccagcttagaccttttgaatttagtggatttattatcccaagatgaaagtaatttcgaataaaaagaggcatctgaagattttggtaagatcgattcttcttctaaaatcggtagtatacctggaatgctgctgtttttctgttcaattaaatcaattgtggtttgtaagtctttgccataatcgatgaaattccattggatgtcttccttttgatattcattttgttccaatacaaacatatgatgattgaaaaactgttgtaatttctcatttgtgtaattgatacatagttgttcgaaagaattatctttgaaaatttcgaacccagcgatatccaataatccaataaaatattcagtcatcgatccatgctctaaactcttgttaatttgatttacaatatattcgaaaagcttctcatataatgatcgggataaagagttaagaattgaccttgcctgtgaggcatttttggcttgtgatacccattctttaccagcctttgatttaggttttagaacagctgacttgaaatcgtcttcctgaactcctagaagtttacacaagggtttgatatcatttttaatgctggcttgttctgacctctctgatacaaactcaacgttaccgatgtgcaatatgatagaaatacatttgagaatggattgaatgtcatccttcgtaaatccaacagtttcaaacgcggatacaagttcctgataattttgaccatcgtcaatacctggaattgatgggttggaatgtcgtagatactggtaatcaacgatggaattcgattctaatccaatagcccgtaactcttgcttcgacatgccagataatatttgataaaaaatatggtagtttctttccctggcatgagcttgtataactcttgatttctccaatagataccattcgatatgtgctccattgatcttaccatattcgtcgaaatcgatcttaatgaatttaccaaaacgtgaggaattgttattgcgcaccgtttgggcgttaccgaaggattctaaaattgggtttgattgtaagattttcctttcaaacgattcgttcgtctgatttaataaaatcttatcatccgtcgtaatggatgccaaatattgtaagattttttttgtattctctgttttaccagcacctgactcaccggtaaccaagatcgattgatcctgcttttgatgcaaaagattctggtaagcctgttcagcgacagcgaagatatgcggtttattatcctccttcggagatccatggtataatttgatatagctgttactatatatcttgatattactgtatgggttaatggccactaaaaataatcctgaataagtgtaaatcaaatcatcttggtacctgttctgtaaattgaaaagaacagaagcttcattaagatgcgtcaattcagacaagtcgtccactttatcaaaggtagaaggattcaccgaggctacatcgtcttcggaaaactctgtttccttaccattcacactaaccacagcaaccgcttgttcctggccttgcttattcttaaccactttccgctctaccaattgaccttgaacaaaaacctctcgttcatcagatacccatactttttccctctgttgactcatgttttcctaacagcctcgtacccaaattgagtttacctgtaatttggtcaatgaggctacgttattggaaccagaagtcaatatcaatgctcttcaattgaatttattcatgcaattgagaccgctagtgtttgttattgattccagttgttcttgatgtttatgttttttttttgtttacaaaacaattagagatcagaaaagggaattgatacgtaaagtaatttgaggtcacgtggattttgtttcatgaagcccatacacatgctaaaaagcttatatgtgtagttgaacagtatatacgttgctgtttttcatgcttttaggtactggcccttgttaatcctgggacaatgaatatagtagatgtggcacgtctgtggcacgtctgggtcacttagttattcactttcccggtgtatttttcaacacccataatacgaattaggttaaaataggtgaaaaatgtcaactactgagaatttattcctagtcgttattgcacctagccgttcgaaaataaggtgtagtcatcaatatagtttgttgttcgttagcatcattgtatgtttttagtgttgttgtgtgtttcgcttagagttccgtgtagacgcaggatttttcagttctaaacgtcaatcaagtatatgctggacatatataagattgaaactagcttgtgacagttaaaacggttcaacctttcaagatgatgttcgaaagtactggtaacgatcgtgtttcctatgcgcacttgagcagacgtgatattatggcacgttatttcaatctttctgcaccagtcggccatgcaggtgtgccgcttccgaagcatgtgattgcaaaacacgacgacagcaatgttgcagatgataattacacctctgctgttaataataccacaaagaatgatgaatttattcttagtgaaaagatattgaatttacccattgaaattaaggttaaaattaccaataatttgagccaatatgacttggtgaatttagcatcggtatcgaaatctttttatgacgcggcgatgttttctttgtacgaaaatatcgtggtagatacgtcatactctatattgaacgattcgttgagaacggacaagaatcaacgatgtacttatatcaagacgaagtacaatttaaagaagtttatgaaatcgttatcacaggatgaaatacaaactgcgttccccttagggatattggtaaaaagtctcaaaatatattctttgcccgatggggtctcgaatatggaaattgtgaatttcgttcatagatccatcaattcgttgacgagactatcatgtttgtattgggaaagcgggtcacggaaattgcccttggacacattacaatatttacccaataaaaaagaacttacctcgttagcgataaatcttgatttatcgaaatgtaccgaggcagatatacacttcccgcaacttgagcggctctcagtggttccattcaataattcggatacgttgtgcaaatttatgcagcagatttcgatagagaccattgcagatcggataaaagtgttacaattgaaaagacaattaccttcaatgaaacagataacaagaaataatttgaatttgggtcaatcacttatagtaacgaaatacatggtagaaaataacctggcaagaccagactctgtggaaactgataagagtataaatcaaagtatgatagacttccagttttggagtttcttagaccctatcttagcatcagcgactaatactacgagtacagccactgccaacgcacctttcaggcagttgaaggtcttggatatcgatagcgtcaatttacttgccagtgatgctgggaaggtcgtccgtgctttcaacttggaaactttgagcactctttcccttaacaacgtcagcgaaatccaatggttacctgaaatagactttcaactaactgattttacaagtgcagcggtcgaacattttcatgaaggtttacttctcaccattgcgccacatttgaaacagttgaaaagcttacggttatgctaccaagaggcgaaccgtgactccatcccgcatttcttgaaccttcttgccaaaaacggtgtgtttttggagcaaattgatataaagataacttgggatgactcaaaactagtcaccgttcttagttgggagcaattgatgcagagctgcacgaaatctatatgcaaacacaaatccaaactaaagaaactttcacttgtcactcaggaatcgttacggtactgtgaagttcctaaagagatacctatcgactctgtattaagactcactgaatgcaaaaatttagaaagtttacgaatcaatggagactctttgcagcccactgggatacatatactacatcgattccccaagctcagattcttatccttacgcggtaaacgatccggaggaccaccgcatatgggtcttcaaatggctcataacggaattatggacgattggtaccgtgtaatgcatgttgccattacactggctcaggcgaacaaacaactacagttcgttaaaatagacaagtgtttattcgagtgtgggaagagtggaaatgccatcccacgtccagatgtgttaaacaactggttttcaaagcaaaccagagtactagtcactgaagatgagttctgacttgatcactcgataaataagaagaagagaaagagatcatacgagaattgaactggaaacttttttttcttactttgtattgcctatccgtggtactaaaataggaaactaatttgtcccatctttcctcatttattgttccggatcgggtaacaaaaagaaactaagagaagaactaggaacagaaaagaagagacgtgctggaaaataaaagaaacgaaaagacacaagcgacacaaaaatgcaactttttcaaaacaaattgctgcaaaatgtccctgaaattttccacagaatatacgcacgaatctgcagatcttacctttctttttctcgttctacggcattcttgctatgtaatgcaagtgtctcgagcgacatttttccgttttatagttttatttttaggtaacgcctcatccagaaccaaaagctgagcaaagaacactatgagagcagtttattttttgccaagtgaagtcaacaaggagagaggggtatctttaagcaaggcaagcccttctaagctgtgattcacagccctttcattatttgctcaaaaaaccgtactcctacctaatctccgaccataacctttctgttacattgctgataatgattagcattatccggtgagggtacggattctgccgtgggtgtttcgattcattctgtatttaagtttttccaggctttatctaatactttccttgttattgcctttgtcactaacagaattaagcaattttgttctaggaacgattagaacttcaactttatctttaagtgttaactctagaagcattagaaccagaataaaaagaaaaaatgtgagacggttccagagtcacaaaatacagggggaaaaaaccgcagactagtcatcttgcaatgcgcggtgtaattcttggatagattagataatttagtcttgtggttcttagataatccgcgaaattgtattttaactccgtaagtgacaatgtatttcttttcgaacaataagttacccaatccctcggtcttttgccaaccaccaccggcacctgcttcttctaaatgtgcaatctcatattctccttttgatgtctgtgtttggggttttcgtcctgatgatttctatttgtaatggtaccagaattggcatacatacccttgtagtagtagtatgatttcttttgaagaaatttctgcatgttgctctttctagtggaaagtgtgtaattttcttttgtgaatttctattcagatgtggcttaccgggtgcacactcttctgagcccctcggaccatgtacgttccttctttctaggtttttgcttggaaactgttctttatcaggggtatcttcggtgtcatttagctctcggaccattgagattcatataaaaccaagtacattaaaatattaaagttttactctatgtaagaagctttactacaaagcagcatatgaagcgtatatgtacaagttctgtaattaagaattagctaagctgtggtaaattttagttcgaatatttttgaataaccaaaagcaacccccactctggcacctacgtagaaactccagatctgcaccaaaaagaatacagatatgacatcgaatgtaatactgttcgaggacaggtgcgattgcgaagccaagttgccgcgacagttcgacgtgctgacgtctaaagtggcattgattggtaattccactgtgggtaagacttgcatggttggacgttggatcaagggccactcagtgcttcatgatgttgatgaaaccggagagcatgaggaagatttgttccataagattatcgaatatgatgcgttaacgaaatcggccaatttccaggaatgttgcaagttgttgaagcatgcttcactcgatgagattaaaaaagtgagcagtaacgtgtatcagaatatggcatactcagattcacaaaacaccaaatacgatgcgactctgaaattggacgtccaggtcgtcgacgtgacgcacttcgatgcgacagattactcggatctcagacatttacaagtgaaccaagcagatgggtttatcttatgttatgacaccaccaaccctgcaacgttagcggatatgacgttgtaccacagaataatcacaagaatcaaaggtgacgacgtgccaatcatagtgtgtgggaccaagatagactgcatatcagaaaggaaagtatccgaggatgaagttatcggattatgtgaagagatgggagtagatttcgatacctgttactttgagaattcagcgatggaaaatatcaacatcgatgaaactttctatgctatattgcatttgatagagaaaaggaaactagccaagactcataccaattgttgtaaagaacctcagcaccattcaatggcaaatgggaccgtgttagaaaagccaaaattcacaaattatttgcaatcttcacctgcgagtagtccattgaaggattcggaaagtacagcggtcagtgtaccaccaaaaagtcccacattaggagagtattccaccacttcgatttccatacctttgttggatactcctacaccgccctcgccagctgcagaacaagctaatagtatcaaaaactttgaaaactatcgtgaagatgctgatgagaagacggacatggaggcacgattcgagactaagagagcaactacgatacattccatgcggaccatggaacaaaatagctcatcatcggagagtaattcggctcgttcctcgagatcaaagggaaagaggaacgaaaagaagaaacgttcttcttccggtaacacctgctgcatcatctgttagataataaaacagatggaaaccttcatcattttagcatcattacgaccaaagacccctgttttcaatgacctgtttttagatagagagatagatccgtagatagaattataatagacacatacaatagcacttttgagctttagccatggaatcgaatatgtgaaatgagatgagatggacttatgacaacggactgtcatctcgtgacatccgcacatcctgtctttattcacatccttctcagcacccgtacattatgaaatttaacaaaaattgtcatttctgcatttggaaaatcgttttgtttgctacccggatattcatcggtacaccacatacataactccagattgtcaaaatgatctccacagaaacactcgcacagcttgcgataacttcccccattttcccaaacatttttccaatttttcattttcaaacggttcgccgcacttttttttcacttcgattgccactctgaggcctgcggatttcctcagtattcacagtgggtaaggaaatcatgttttcgatagtgtaaattttgaaatagatttgatacttttgatgaagagcatattagttcttaaagttttttaatacacttttatgggttagcttatacattttactattcattagagaagctcaccaagtacaagcaaaagtcccaagatggtatgtggttaggatctacagtgaatatatcgtttgagaataaggaatagagaggttagcagataaattagagatagaataagaggaataatgggaatattaataatagagaaactcagtttagagaaggagagaaagagataataaaccaaagaagagtcctgaactcgtctgtaatatgaaataatgttatgaaggatgctggatatggcctcatgttgaaatatgaatgtttccttgctcaaggagataagatgaaagacagacggagacagaggttgtatgggactgtacaggaaaagaagaagaaatacgaccagagacgttgttcgggctgtcagtacagtggatttctgagatattatacgaaggaaacgcattttggatgagatgaaactgtgtgttctccatcagtaaaaatataatgaaaatactattcgccttctcatttctttttattgggcgatatgtgatgcacaaatatatgggttgtccatgtcaatttgttgactgcccgtattttcaatatggaataattttttactaacaataacacattcatgatggcattctatgtctatcgtatatcttcttttaacaggttttagttcaagatttgttgcacccaaccgctgcttctgaagctagaaagcacaagttaaagactttggttcaatccccaagatctcacttcttggatgtcaagtgcccaggttgtttgaacatcactactgtgttctctcacgctcaaaccgctgtcacttgtgaatcatgctctaccgtcttgtgtaccccaaccggtggtaaggccaagttgtctgaaggtacttctttcagaagaaaatagattaatcactttctatagcacaccaataattttaacataaaacgtattcattctgttgtacagttacgagttgacttctcttctttacactgctctttatggtccgtggcgcctgttttatttggcatgtcattgacaatgtgatgctggtgtagtatggtatatgtatttggatgtaaccacatagtaatatactagaacgttatgtcttccctttaaagctaaagtaaaattcatatttgaattaaaataaataaataaatataattgacccagtgtctttcttttataatgggatgtagttattagttatttacaagaaattgatttgttaaccctccgctggaagatttaatactcatccactgccaatttccggttggcatatttcttctccttctttgcattcgataactggaaattgtgctcatggaatttagctaacgtatcaacagctgattcgggatccatatgttctctttcattgtctaattgatttgccatgtctttcaattcacgtgattttgatttcacagctctcttcatcttcttgatcttttccttatgcagtttctcaaatttatttacatttaaggcacctccgcctgctagtttcgtctttgcatctaatgtccacaaatctcccttttgagtctttctagcatcgtgatatatctgtttgtctaaggattttgggacaatccacttctcaaatttaccagatggtgcgcagagatcgagaatcacatgtccttttctcttagtaggttgtttaacgattctaggccacgtattggcagtttcatctcccaatgagccaatatcgtacttaatcttattttcttctctttcacgatttattgcttcagtcgtggctcgatcttttgaagatctttgggcaatcaaatatgaatagtttataatctcaaaactcttaccatttcttctacctgagcctggtgcagatttccccttgataccgataccatcagttggagtttgccatggtgcagcaagcactttgcccttctttaattcaatagtaaatcttggccttagtacagtcttttggaaattacagaaattcaatttcgaaccttcatctaaatcgtaataatgaggtttccctatctgtaatggacattttctatggtgtgaacaaggtgcaacgatcttgatgaaataactttcttcatcactagatgttcctcttttggaatcttccttttcaatggcttcaagaagttctggttcgaattctaaatcttgtttgtttatttctccatatttggcatccaagttttccattaactgtttatattcgtcatcatttatgtttaaggattcaagtgtgggctcttcgttctcaacaggcactgaacgataactggttctgcccatcatcttattacctctattccagggtcttggaatcttcccgtgttcttcaggatatttttcaggtctgatcatgaactgtcttgcccttgcaataatctcaaaacccattggattgcccctttctactataactagatgtccgttcggggaaagaagcttcaaataatgatccaagttgtcatcgatttgggctgggaatctttcctggtgtcttaagagctgatgagttaggatgatcaaatcgtattcgttggaaccaggaacatctttacgcaacctcgtgttaatatgaatactcttcgtagctacttctcccaacatctcgtcatctccttcgatattgtcagcttcttcttctttcgtttcgacattctcagtgggctcttcttccccgtataacatgtcgtctggaatttcattcaattgtctactcaaaattatttttgccctcttttgcatctcaatatgacctatgatagtggcttctttcactctgggtctgtactcttttcccattaaatcgttcaaagcaacaataccagtggctggcccataaccaacatctaatactctttgaggattgaaactctcccctacccttttcttaagttctgataaagattgatatatggcagcataattctgcacaaagattgatgcgatatgagaatccacttcgatgttcgatgatgtaggtcgatgaagggagctttcgtataactccacgaaatatttggatgcggctcttcttagattaccaggtatatgtagagacattatgttgttctggattgcttgactcatcacagacggcaattggatctgatctctcaatacccgtccttcaagagttttgggtagaagtcttgcctcctctgcattttcaccttgtaaatgattcccattttgatctctgtaatctcctttaaccttatccgaaagcaaatgatctctctctataactattgcgttatctttctgagagtcatcaacaacagaaccaaaactggttggcgcattatctcttgtagatgcatctaaatcattaacgttaatcgggaaatcggccagtgaagagtaccttgacacaggaatacgagtgaatattcgagggctaagcgttcgactgcaacgtaacatattggtagcttcttgtctgggctggtgtcagtctatctatgtttctctatccactgaacgtcgccatctcatcgcatctccaactgatttctcatacaaatttacagaatggttttcaaatctttttttttttcttttaacttttcagcctgataaatttgttaaacagtttaaagtcaacatggacatatagagacccggtgatttcagttagggttgctagttctgtgagtttctgttgcatctgaagactgtttctaggggcttgaacatcgaaaccgtaatatatatcggcaatgttgtcgacaccaattttactagcatgcattattgttatgatcagtgcagcatttgtgctgatcgtacaaaagacgagtgccaacgtgattcctggtgcttctaaatacaccaatagagcgcccactttcatcattgcaggcttgccgcaaacggggaagactgcattgttcaatttgttaaccacagactcggtcaaaccatcggtgatgtcacaagaacccaatgtggctgaagactacatgttaccaactagtcataagaatttcaagtttaaattgatcgatttcccaggacatgacaagttccgttctgagctgctccaaaccatcaaggattcgagtcaattgaaagggctcatttatgtgattgattctactattaatcctaaggaattggtcagtactgcagaactattgtatgaaatattatctgtcaccgaattaagaccagacggagttgacatcttgttggcatgcaataaatctgagtcattcgtggcaagacctccatcaaagatcaagggtgctttggagaaggaaataactgaaatcatgaagagaaaggccaaaagtttgaaggcaaactcgaaaaagtccttgagtgacgatgctaatgacgatgatgacgatgaggttgctgttcttcaacaaaactcagccggattcgaattcgatagaattgatgggaatgtagatgctaaggagggaagcgttttgaaaaatgatattgataagtgggaatgctggattgatgaacgtgcaatgaattaggcgatctgccttgttgcctttcaggaatttttttcccatattcatatatagcacatttaataaagccatgtaatgaactgtgaacgattgcgatttgtcatatccttttcagccttgttgtttggtcattgaatttgaagttaaaggttaagtattggtatgcgttggtttgtctcttgtcttcggtacatcactgcaatcattccataacattacagcaactgaggttccaacgattgaagttccaagtagtaacagtaatatagggattccaactgcatattggctagataatgggaaaagtgacactttttgatcaagatcaaatataggtaacagtaaccaaacacaataatagataaagagtgctaaaataatagaaaaggtcttcatagctgcagatattaaagttcaaaataagagcaaatgatcctattacagtatgatattgttgccattcacttcattcagtggtaaagatgcaatgttgatctcgaagtcagaaacttttaacactacaaggtgagcgcgaagttctcacacggtatccattcaattttccaacgacataaataaaggtggagtaaatgatacgagaggaggagtctggtactgttctaacttcttgttgtcataacagttgctcgcgtggcgtaatggcaacgcgtctgacttctaatcagaagattgtgggttcgacccccaccgtgagtgctttatttttaaccacttttttttaacttagagaatgaaaccgctacatcagatctaacataactgcacttcaatatctatctgttgataactagcacgagaatatcagctgtcactcagtacttacaatatgtttttcatcttcactagtggttgtgaaggtatgttctcgattcgcaaatgatggttaccctcgttttacttttactgttgataatttggttccattattaaaaatttgaagtaaataatagtaaataaaataaagatatactgaatttacatcagtagggctgatctagtgatatcatcaactggaagctacgaaagcctgtactggtcgaagtactgtgtgacatataaattcaataatgtgggcactttcaccctttgcctccttgtatgaatccatacagaaagctgatttccgtaccgatttgttcaatgagtttgtatctgatttgaagacgttgaatttgactgataatgctaagaaaaatgctgctaagagacgcgaattggaatccggagaaattaagctatccgatggatcagtgtacaaattgaatcaggagttcataatagaagtaatcaagatttccgatgagctagatcttgatgaaattgtctgtgcggaacaaatattaactgcagaggactcgtcccaagctgtggaccaggacatatctttgcataacaagggtctactgatatactatctcagaagacaatatattttacaagtggtggcatacgttttgaatgcactatcctcttcagatgatgtttttcaaacacttaccagtgatgggactcttttaaacaatgttttgcaagcattcaacacaatccataaagaactagaggatgtgaaggcacttgtaaataaggcacaaatccttgataattatgatgtggtttcgaaacagaatattacgttcagaagggatttcttgatcaaagaatatgacacgttaggtactgttcttttcggtttgtccaaaaataatctactctctaatgcaacggtaatacaaaaggttattgaccatgttacatcgctagcctctgatgatttttttatcatattttacctacctgctataataaatactttcaaaaatttggcatccttctcctccagggatgttgaaagtttgcacgcccaattcctcagagatttagaatccgaatcaatatacactaaacccaccaaggttgttctcatcttcatcttcttaacgttctttataggctggtgcaaagctgaaccaactacaagagcaaagcaattcgacttcgctgttgctgtagaccttccaatgacttctgcagtcgaattgggggcaatcgaacagttgatggtatacgcagcagaaacttcgatggtagaagcagataaaagcatggagttattctttgacatacggtccttgctagagaagcatattccaagaatgtcaccaaaactcttgttagatccagagtactcaaccgcagtaagcaccaaaacttatgttgatgacccttctaccaaatactcaaatttatcaattttcgactatggactcgatagctttctatccactttgcatgacttctttcaagcttttattacagactgtgcattcctcttgacaaagataaaaaatgctgaggaagattctttattatccggtgaggatctctatttggatgacatctcagcgaaggcggacctagaacgatttttcattaccatatacttcttttatgcatctagaccggaatattcaagctctttctgggatgacaaagagtctaatctctatggtttcatagaatgggctgcaaaatgtaacgatactttgatgaaagcatgcttttacttgatgatttccagtttgtcatatggatctcaaaattctcataatgtttatcattatgtggagagtaatcagcatagttcctggaaatatattgcacataatataaacgaaacaaccgaaaaaattacacaacttgaacagaagttacaagatctccagcaaaacggcgcagcaacaagtgagatcaatgcggtggcaattgaaagtgggttaagtgaagaaacaattatcctgttgtcttcgtactttaccttggttgaatctattgcatataatgttgatgaacaaataaaatcgcaattagctaacacattcgaagacatcctcttcagtttcctcaaagtaagaagtcctttactaggtgcagcgctaaaagtattaagtcatttgatccctaaggaagaaactcaaaggtacggttactggaccaaactagaccgactcattttcaaatcatacccgttagattcaacagatagttcctatattgcagccttcaactcaattttcactggctactccgaagtcttaggatttttgcaattgttctccagattggtgtctgtgggaacaactaatcatagtaatgagtatatgaagtttggtaaactaagttttcctgtgaatattggatatggatatagaaagacaggtgtatggccttattatgagtatattttgggtaatattttcttgaatgatgaaaaggcagctaccaaagaccagcaaacagtcaagaacgttttggttttagatattatcaaatcttcgcttttatcatttgactacagcgttattttgaactccgtttccgtcggttgtaatttggactcgtttgtacagacttccgacttctattcctttgtccaacaatccaatgctactgccacaatgaactacttgtacaacgaaaaagtgttttcaaagatcttcaaaatagcctctataggaatagatgagctggagagtgaacttgggcgtattttgaagccgaagtcgttgatggtcagggattcactatatatcattgatattatgctaacacacgaaggaacatatgccgaggaattttatcctatagtgaaacgctgctctgataactcggtgtttctacccaaaagtatcagcataagaggattgcgtttcttctatgacgctatcttcttcaatcttccattgacagctcacttcggtctttatgttggtagcactaattttgacatttctttgagcagtattagcattttaaagaagttagcgactaaattggactcgggaaatcctagaggtctccacaaaagtatattattgacggtattcgattctgttgatgattctgcaagaataaaacaaagcttcattgatcaactaatgtcgcctattaccgatgaatgctcattgaaattaaaggtgaatattctagatttcattagcaaaaacttgtcttacacagatcacaacaccaccatatcacattttcttttagggtatcaagtgtcgaatactatttcattggggccagaattagatacattcataaattctaagacttcgttacttcaaacaatcgtaaaccttatgatcgagtcactatcatgtattaacagtcttaatgttgaatatgctccaatgaggttatgtgcagaatttatggaaataattacaaagctttgccgtaatcctttgacatgcaaaataactttggattatctgtcaactctggatttagataaggttcttctaagcatggacccaaaggtgtctgtgttgtctcattggaatggagagcctttcaacggagattttgacaagtacacctcgaaatttttaaactcgccagctatcggatctcttctttattttttgaaatatagaagtcttctaatgcaatttctaagtttgagtgtccatactttctcctatgcggccaataattcaaaatgtgatgacctcatgaaagctcttgtttctaacgctatacattcagcgacaatcttttcctttttggatacgttaaacttgaaatctcaagctccttccactgatccctttaaagacattactattttggaaggcttggatctcagcctggacaaagttgaaaagaattcatcgataaatggatctctttatgatttttcgaacctggattccctgattgagcttaagaaacggtctgaaacttacctctcgattacatcaggtcatccaatagatgcccaacagctggaagtcggctctgagaaagagatcgaaataattaagaaaacatccaccgccttccttgcctatcaggaattagcaacatttcaactttctggtcttcattcatgggttcaattggtgcagataattgttgttgacagtaaactttctccaattcaaagatccaattttatattggaagtatttgaattcattattcctaaagtaaacgaatatgtcgaatctcgccttccatattctgaggaactagtttcccttgctgtcttcctttatgaattataccatgaggatagagttgccatcgataatgaaaaaaccctagacagtaggttgcatacgcttttcaagacatgcataaactgtatatcgacaccatcggcgactctaagatctgatttttatgtgcttggtacaaagtatttgaactgtgtcctaaaggatgaaatcctttcaaaggaggtccttcaatggctgaagttttccaatgaatcattagtagagactgtttgcaatgatgctattatggggcaaggtgctaatagagtaacaggaatattgtttttggatgctttaaaccaattagcaagtttgaacaaagtaaattttgttttggaatcacttgtcaaaagtaatatgttattattgattataagatctatcaaaaacacagatgaggtattagagactcaaaatgagaaggtgacctcttacacattattgtatgaactcacaattttcaaatgtgtggtacacttcctgacaaaattggctcaaacaaaggctggttctcatgctttagttcaaaagaaattgtttgaaactattacgtcgtgtaacttcttgaaaatggatccagatcttggactagaattgatgtttgaatctgttggtgctgcaacctccggaaaaatccgtgcgaatctaactttagataaccctctccagattacatcatacgaaaatggtatttcgctctttgaaatcattatacccatcttccagttgattgcgtcagtgttactcagctcaggaacatcaagccaatacgttttccgtgaggcaagaaaattgatatctcatttcaagcaattggtacaaggcgcattaaagagagatgcattacttgaaaagaatggagttgaaaccaaaccagaaggacttgaagaatttgttcaactcatcattttggtttgtacactgacaaattattctggagcgcaataacgatcagggcaatatggttacatgattattagattgaaccagcaaagtacataggtttcaatatatagattatcatagtattaacctcaaggtcaaaaaaaaaaatcatttctgagacttcgtcaacgtcttgagttttccttcaagttgctgagagttgttctctagcgacttaagagcatctaggtgagaatttaataactggatcaactgagcgttttcttccttattagggaagcttgagtttgtagccttattgaacgtttcgctaacttcgtttatttcggtaatcaacgaggaaagatttagtgacaaagagtttaggttgtcgtcaagcatttccactgtatgataggcttgttgtctcttttgatcattcgttttgcttgtgttgttattgttgctcgaagaaagcacctcagatagcagatcttcagccttttgttcataagaatcgaggaaatactcaagttcagattgttgtctttcgatatatgagagagactgatctactctattttgagattgttcagcagttaatgtatcagagtacaaccgacttatttgttcaccaccttgcattaatactttgtcccactgatttatcttcttggcgtaactctcaaagtgatctgcggttccagaaagttgggaggtccattttgatactaagtcatccaaagtcttattgtcgagggaaacaggttcgatagtaacgggtttagtagatgtctttgttccagttgtagtttcctgcttagcactttcagttgtttctttggtagtatccggtttcagaccgcccaaagaaaaggaaggagcttcagttttcgtgtctttggaagcggtagtttccgcaggtttacttccaaagctaaaagcaggctttgaatcaaccttagtgtcagatgttctgctatcggcaggtttacttccaaagctaaatgcaggcttcgaatcgtccttagtatcagatgatttgctatcggtaggtttcgctcctaacgagaatgcggggctaggatcggctttattttctgaggtgttggaccctaaagcaaaagatggttttgattctgactttgacccgtcagtcttgttatcgaacgaaaaggccgctttggaagctgacttggtatcttcagtcttattgccaaaagaaaacccaggcttggattcggtatcgtcagcattcgtgttcaaggatcccagagaaaatcccattttagaggcaggtttagattcttctgttttagatcccagagaaaatccacttttggtctcctctttactgttgccagatttaacattgaatgcaaaaccctgtttactttctggtttgtcattggaaggtttagagggttcaggagccactggttttgatccaaagctgaaggctggcttaccggcttgttctgtcccagagggctttgctccgaaagaaaatgctggtttagcatctgtaggcttgtcctccgtttttgaaccaaatgagaatcctgtctttgcgcctgaggttttttcttcaggttttgatcccagacttagcgaaaaacttggcttgttggcatctccagcggcagaaccaaagttgaaccctgaagtagcaccggctggttttgtatcagtgtggttcccaccaaagagtgatgtggcatttgtattaggtttcgaggtttcagttggtttagcggaagttgtgaagcttgatgttgaagttgtattggcaccaaatattggtttagaggcattgacactcggagttgtagtcattgcattatttccagatagtccgaaattaaaagcgggctttgcatcggtcttttgttcaggttgtgtaccaaatgagaatccactcttgggttgagtgtctttagcctgttgcgacccgccaaatagcgaagagctacttcctgctgctcctacggagccaaagccaccaaatgttggttttgctgcgcttgtattcgtggtgttgctgttgttattgttcgcattgctggcagcatcgtttgcgttaaaacctccaaaagcaggttttggtgcatcgcctgtaccagcagttgtattagaggcaccaaacgaaaatggcgaagctgctggcttgactgcattagcgccctgttgtgtattcataccaaagcctccgaatgcaggttttgtttgtccattgtcattggtagtggtcgctccaaacgctgaaaatgcatttccctgctgcgtattagagctaccagcagctgaaccgaaacttgcaaaagcattgccactggtctggcctccagtattgccaaagagagaggaagcacctgtgctggtactggtgtttcctgtggtagatacattttgtcctgatccagtaccggcaaacaaattggaattgctgttcccaccggaagcatttcccgctgtagaaaagttgaaagtggggtttgaattgaaactcattttgttgattaacgaacccttgtaattgtccacttcatagactagctatgcctattcaaaccaattcgtttgccattatgtatacaattttcagtttattgtttaatcatatcgagttttatgatcttttcgattttagaaagaaacaaggtccaaaaaatttgagtgagggtaaccttgatatgatgcatatacggatggacatataaagcttgactagccagagtaagctctgttttaaagtttatttcctaatattataatgaatgtatagtaagatttatataatgtacagaattcaatcggagtaaaccgagcttgatggcttttatgtctttcgattctctcctccaatatcaataacggttaacaatggaatagagttttcctaggaactataaatcacattaccaactttctgggtaatttgatccaagagtaaggcatcatatttgtgtttttgatcatctcgtatatctcaatgcattaggttaaagttccttttgaaaaaaaaagaaagagaggtgaaagtaggggcagacgtatcccctcgaattagtttgtggttttcatgtctacaattctccacgtttcttagacggaatgtaatttgtattctctttgggggctatgtgcattgggtgctgctatgttgagcctggcgaattatttgatttcgcaagcgtggtctttcttgaatgtgctagagtgtctaaaacttcgtcaaacgcgcggtccatttgttcttcttgctgtacttcttcctcgctactataatcgctatcagaatacccatcacctttcttctcctgcagattggcttcaactcctacgaccgtattagaactttggtcgacagaggaactagaagcagttggttttttgtcatctgatttcttcttgaaaatttcgtcaatgggaattccttgattgttcaattcatcaaggagtgacataatattagatatatcttgtttcaaaagggcgtctttgatatatgttcactatcaaatctttcgccaacccttctcaaaatatctgtgttaagctcttggccacgtttgttagcggtactttgtagttcattcattaatcctctacttttcctcaaaacatcaccttcttctttcaactgttctttggcttcgttctgcacttcaccgctcgtgtatgttagtgccacctcgtcatctgcaggttcatatgattctacagatggttgatggaagggtaacaaagcgctgtggccactggaagcatatttcgatgaagaaagtaaggtgtttagtttcttcggataagttaaagctgtcgcagattgtgaagttaatggtgatgggctttcacggtcatttgacgtggctgcattatgggaatggtaacctgcgcttcgcaaactcttctttgctagtaatttcaagcccttttcaaaacttgcgtcaataaagcaaaatttaataagagtttctttaccctccgtacttagctctccattgagtctcaatttgaatagttcttcaattgcagcatgaagtttcgcacgtacagtttgaatacgttccaagaagtttgacactaatgtatcataatcactcctggttgaagaatcttctgttagtaaccttccaagctcttcttgtagtgacttcaatttttcatgtccatcatcgccaccagatttattaatttgttcgagctctctctgtgtatttctcatactatagacagagattttttctttgattctatcagggacatgggcgtagtcaatatccattgtgattatagtcttggaattttttacagcagcagccaatgcactggcagatattatattcaaattggttcccaatagagaaatataatttatgcgttgacacatcggcaaaacttcggcaaactgcattactgccgttgtggataggttgttgttatctaagtgcaaacgaagcaaagacacaaacactggtaaaatagctgtcaacgtacgcataccgtatgggaataatcctgggttattggataaatctaaaaatttcaaactatcacaatagcaaagaccattgagcaaactcaaaacctcgttatcctcagattttgcacctttaggaaccgaaagatttgtagagttaagagataggaatttgaacacattttttcctttcttcgtcttctctattacggcagatatgaacggtcctaattttccattcaaatcattgtaaccaacatcaacaccttgtattttagagttagtcatccaggttgcaaggcattgacattgctctaaagttaagttattgtaggccaggccaagtcttaatgtctttgtccaagcaatatcaatgaagttttgtagttgaacttgattcatgaaggcacctgaaacgatcatttcttctaagccacctttagctgccacggccgcactaagcaaactccagttcatatcagatctgttctccatattgcaaaccattctaggaacagttgagccatttgatgatttagatggcttttgaacattaagcgctaatcctggaatcatggtaacgtcgagcgagtttaggcttttgcatttggatacgaaatatgaaaggaccttccacccgtcatgatctacaggagtgtttctgagtgataatttttcgaatttatccttatatgtgatggaactcaaaataattctcaacatttccacgctcaatgacacaccgtctaaagatagacataacaccggagcgatactcaaaaaatcactgaaagaaagcacttctactttagaaggtttggggtttcttaattgtaggaacggtatcggttccgttgatccctttttcaactgcttcatagtagcagggatcggaagaatttcccttagatgacaacaacgagtatacacaacatcgtgagggatctttatatttctgggtggtagaagttcgttttcatcttcagaaggtaccaaggcagaatccgatgatatcatggatgccaatgatgtgctagaaccttttctccttgatgtcattggcttgtcaatggtaactttctctaatgtattgttgacaccaacctcttcttcattatttgtcacagttctctgtaaatctagtggagcatctttagctctggcctctgccgcagcttctgctgctgcaagttcgatgtgacgacgttgagacgcatggtcatcctcagcatggagttttaatgcagcgccttcattttgatccggagacgtcgctggtgcatcttggttgattaacttcaattgcccagttcctcctaccacaataccacaacttgacttctccagtatttcacgtttctcttcgggagttaacctatggataacaacagatccatctgcttttacttcaacttcacctttcctagggttcctggaacagatctgttgaggaggatcattgaaatacgtgtttgcagcaaacgcaacgcgcttcaaaggtttgagattttccaatcccggaaccaccgaagtatttatagttccttcagaagaatcgacagatgactcatctgcatccctgggtaacgatattgatgatgacgctgaagacattcttctacttgatacgaaggagtcatcggtatgagaagtgacccttttcaagaaagaaccgaatttgctggcacccgataatggtgtatggctcgaatcaggtcgagaggatgatggaactggctcgtatcttaccttcaatgcaggtggtaaacgagacctaggaggatgtggcggtattggtctgcccttcttatctaaatggacttttccattactgtttccatttttactactaccgactagagtagaatctaaagagaatattgcgttgggttctttggttactttctttgcagcaccattctgctgagatgagaaaccattgcaaccatgttctttgtaatatttgatgaactcttccaatctaggatccaaatcctgttgtgaagcctgtgattcagtttgaactctttccaaagggactccttccgcaactctactgacgctcggctcaaacttcgtttcaacgtgtagatcatttaacccttcgttctgggctaacctttgctggtttgcattccgcagcgacgctgatgacactgatttgcttctcgctctaccttcatgatggctataatgcgatccagcttcgccatttgtatccaaccttattgtgctgttactactgctgctagaactgacaggtttcaaagatggtgatccaggaggtggtgaggcactctctgcattggaagaggaacttttcctcttgaataaatttttgaaaaaccctgatttcctcttatgtgtcatttcgggcagcgatgcagattgtgtccttctcaaaggagcactttctaggtatgacgacgtttgtttctgcggcgtttttccatgtcccatcttatgatcataaccgtttatcccagacatatcaatcgcactgttaggatcaacactagaattacgtctctgttttacaatcctattcggacctatcacttcaacgtgcgttgttacatctggattttttgcatccaaatcagatatcttgacagtagaagatatcggggagggagttccagtcctggcaccatgcgaatcggaagaagcaagggctgcagccatagcaccaccaccggacttgctctttttgcttgactttgatccatggtcatgatcagaacacctgtttcgaatcaaccatcctacatctaacccgcaactatcgtctttacccatggttcggagaatataaagagtttttttaaggaaaggagtaacttgatatcagcaaaaactgtgtacttcttttttgtttttgctgctgctagccccttagaccctcaatcttggatttatatctggagagaacgatgtggtgtactatattagaacaaatagttgatcgaaatatccgaaagccaaaaaaaatggtgaggattttctctgattaaatgttctcacgtcttaatttgaattccacggaataataaaaaaatatactatggcgcaatgcaaagcgtcgacttataacacctttcaccttcgatatatttagcttgtatgtgctttaataatgcagactgttttttctctgtctactactttctcgtttgaacgcttgttcgggttttattttgtcttccccctcaaattgaatgtagttatttgaagacttgaaaagttcatgttttgtttatagagaaatcctttaaaatataatcacgttgaaaagtttcgatgcacatagtgaaactagtagagaaaaaaaaaaaggttgaattgagaccatacacgcagagtaatagcagcatcacatacctaccactgcggtagtaaagtcgggggatcaattggttgagggaagaggaagtgaacgttttatggtccttcctgtggtgataagtgctaatatatccacgatatagtatgaattccagtagcaatgggaatcgtttcggtattcaaaagttggaagcccatgacgtaggaaatgtcgatgaacaccccttagcgatagtgaatggcgtaagtatgatggacagtcaagagatgatagaattggatgtagctaggctacattcaggccagcttaatggaccgcaagaagagaatgcattgaggcagatattagtgaattgggtgaaaagaaacggggtagggtacaaacagggaatgcacgagatatgccttgtactatacctagagaacgacaaagacgtagatgagtgttataaaaggtttgacaacgtgatgaagtggttatatcctttgttttatagggatagcggtgtaaatgaatggatcaagaacgattttagtccgatgttacgaaaaatgagtcctcgaaggttgtacgaaatcatcgtggtaaagttccaaatttcgcatgcggtatggtgtattcgatggtgccggttacttttcattcgagaattgagcggtcctgaccagtatctgcccatatggtatgaattgttcgatattgaaaataagggtaaattcattgcatgtgtgacaatagtgatgttaatgtgcattgtaccgcagttgacagaggcgcaagacgaaagcgagtgtttgtatttgttattgaactatccaaaactatgcgtaccgattgaaaaagttgtgggatgggcaaagatcatgtacgattatcgtgctgttaataccatagattcacagcatgcagattcagatgcagatgcaaatgcatcgccgctcgaagaagaaattctacaaggtagtaacggtgaatggtacaaaaaatacaaagattatgacgtaaatagactgcggatggagatgaggttgaaacgacgtgcaaaatggcgattatccaagtgaaaaatgcttgacatgcaggttttccttgttaacttttttgtctttaaaatttattttatttcattgtcttaaacataataatctatactaaaaataagaaagggaacattatttcatctatttcttaccttgagcagcgactgcggcagcacctgcagcagcagcttctgggtccaagtagtaagaaggcttggttggcttcaagttttcgtccaaatcgaacaccaatgggataccggttggaatgttcaacttagcaatgtcagcatcggagatgtgttccaaatgcttgaccaaagctctcaaagagttaccgtgggcggtgatcatgacggtcttaccttgtagcaactcggaagagatgctgtcttgccagtatggcaacaatctgtcaatgactagagccaaggattcggtctttggcaagacacttgggtcaacgtcaccgtaacgtgggtcgttgctttgagagaatggagagtcgtcttcgataactggaggtgggatatcgaaggatcttctccaggtggtgaattgttcttcaccgtattgttccaaagtggcagccttgtccttaccttgtagagcaccgtagtgtctttcgttcaatctccaggatctaacgacaggaatccacaatctgtcagctttttccaaagcaatgttagcggtttggatagctctggtcaatttggaagtgaaaaggatatctggattaacgttgttttccttcaacaattcaccagctctggcagcttcttgttcacccttggcggacaacttaacatcgacccaaccggtgaataagttcttttcgttccattcggattgaccgtgtctgactaaaactaactttggcatattatattatttttttttggtgttgattggttattgggattacagtaattattattattattattatagcagtattagaattaatgtcaaagaagcctttataagttctagtaatgcgatccttttataagtcaaatcagtttagaaaaaaagtggacgatgggtgatgttcatggtgatggtgaggtacgctgacctgctgagtagctgctgagtagctgctgagcagctactgaagcaggtgctgtggcagatgtcgagcagctcctgttcaactactggcacacaaccgggggacacgaacatgtgatgggaatggttacaggaatcccggggcgggaagccactgtttcttcgaacgagaaatgagaagccagaaaaaaaagtggatgctccgggaaccataccgaaaaaggtggaaagaaccaaaaaaaaaaaaaaacacatatgttacccggatgcaatatgttgcatccgggtaacatatgcggtttccactcacgtgctatggatatttgcttccatcacgactttcattttcttttgacgaactgccgatcgcggaagtgctattccctacttctcgtctatgaagaagttaataaaacaaacaggcaaaccgatactggacatttgtttcaacccttaaggttttaagtccgtacttgcttctccaataaccttccgtttttcgagtcggcttttgcagttaagtatccctccatttaagtttatttgccactaacatatgctcctccccgctaattaagggtacttcctagaaatccctgcacggcacggacacggcttagccaacttttttttgtgctactgcgttttgttgtcgttacttcccccctcgcaacaattaattcggaagttggatgaaaactgaggttaacaaataagaaagagaggggccacaagaatccttacgccgacgacaaaacagccgactgatcacacttttcaccctagaagtgaatccacccagccatctatagtacggagtagtgaatttgctttacgtctatagtcttttcgctccaggagaaacccttaggacactcccaagtgggtatttcggattctccaattctatgcgtgatcacatcaaatccccttaaaaaaaaaaaatggaacttctctcagaacaccagtgagaacagaccagccgcctcgacggcggctagtcgtttggaaaaattacacaatcctctgtaccggttatcgccaggcttgttctgatgtcccacttaatacttagcttattcagccgtttcaactccggccttatctatgaacccttcatccttgacatctgacatctgacatctgacatccaatggtaccaggacaatggtgatacttttctcttcgtttccaaatcgacgttccccgcattttctcagccgtggcaccaccacgcaatctcatctttatttttgtacagccggtccgctattctatttacaatttacgtgtgagcttccaaaagtgccagctaagtggtactttgttagttatttttttgttagtagtaagttatttttttcgtctgattaaggtagaacagaccgataataagcaagaaaagtaaactgaggagaagtgagacaaagagcctatgcagtttgtttcacaaactgtcctttttttccggggtccactccactctgccagtttcaacaactttaatcattcatttcggtctacctctaaattttgagaggttacaatgttacgaaatagttatgttgattattttgttgatgatgatgatgttgctaatatttggacgcgacctttggagaatacagcaaccagagtccgaaatggaaaaaaattgtataaaaagagacgcttttatctcgcataatcatatctcaattctgttccaatttcaaactgtactccctttcttctaagagatacatacacatatatcaataataataataataataataataataataatagcagtcgctaaaccacatctagcacagaaaaaaggctaaattaaaatttaaactaataaccataaccaataatgtccagtcaaagctcggagaaacacaaccatcaacaccaagaaaccgctggtcaccctaccgcggcatacaattcccaagaccctaacgtgtaccatgacgatttggaacttcaaaaggtccagaccggtggtgaaaatcacgagttcattttcattggacgtcaaaagttcttaaaggatgaattgtacggtgctttcggtggtactttgaacccgggtcttgctcctccagcaacccacaagtttgctaatcctgcaccattgggtttatccgctttcgcattgactacttttgtgttatctatgtacaatgcccgggccatgggtgtcacagttccaaacgtggttgtgtcattggccgttttctacggtgggtttgtccaaatggtagccggtgtctgggaaatcgctttggaaaacacatttggtggtactgctttgacttcgtacggtggtttctggatgtcctttgctgcaattcatattccttggtttggaatcggagccgcctatgaggaggctccggaccaattggcaaacgccatcggattctacttgttaggctggaccatcttcacagtgggacttaccgtatgcacaatgaaatctactctggccttcttcagtctcttcttcctattgtccattactttcttgttgttgaccattggtgaattcaccggaagaactggtgtcacacgtgctgcaggtgtgcttggtgttatcgttgcctttatggcttggtacaatgcatttgcaggtgtggctacgcgcgaaaactcgtacattactgtcagacctttgccattgccaaaggccaagtttttctaaggaggaatatcaagacttttttgttatgcgattatttccacacgtttattcactacggtaaaagggatgtgacaagggtttcttctttctccctcaataacaatacaatttactattaatgatggtaataataataatattcaacaataaatttctgacacgtatgattccagtgtttatgattttttttttcttcctttctttctttctttatttctctacattcaccttgttagaaattctcccttgtccgtgccctcccaaactggctccagcttttatattccttatttaattataatattatgatgattttgatgattatataaatacaccattgttttttcctattttattctggttttacacgccccttctgatattttggggaaaagccgctgaagttctctgcattaccttaatttttttctcggcattgatattctgtatcgttatttacgatgtgtccccttttccttgggtcttttttctctgaaacactaaaaagccactaatcacacaatcttgaaacagataatatatattacatacaaatataacatatatatatcggtgcatcatcgataggagaacttatatcatttagcgttatcgcagaaactagttgaataagttcaataaaggttcccaccaagtgaactaaaaaaaaaaaagtttgtgtttaatgtcctgggaagggtttaaaaaagctatcaaccgtgctggtaacagcgtgctcatcaaaaatgttgacaagactcatgataaagattatggaatggaagagcgtaggtacagggtccttgagaaagcaggtaaggaattacagaaggaggcaaagggatatcttgattctctaagagcagttaccgcgtctcaggtcactattgcagaagttatctcggatttgtacgatgattccaaggcaaccagcgcgtcagcacacaatatagggaactactatctacaatgtgttagagattttgatacggaaacggtgaaacagttggatgggccctttagagaaactgtgcttgaaccaatcacgaaattcgccacttatttcgatgaaattgaaacagctatcaagaaaagagaacataaaaaacaggattacgatgcagcaaaggctaaggtgcgtagacttatcgataagccggctaaagacgctaccaagttacctcgtgccgaaaaagagttggccttcgctaaggatatttacgataatttgaatgaccaattgaaattagaacttccacaactagtctccctcagagtgccctattacgatccaagtttcgaagcattagtgaagattcagttgagattctgtactgaggggtacactagactagcgcaaattcaacagtatttggaccagcagtcacgtgatgattacgcaaacggtcttctcgatcaaagaatcgacgatttattgcaacaaatgtcaaatctaaacatttgcgctctaggtttcaacaaataataagcagcaacaacacagtatatatgtatatgtatgtcttcatctcacattcacgttttaatcctactgctggctgagtcgtctgccctctcgcactatcccttgtgttctcccgggtaacttcatattcaacatgaatttttcgaagttttcggaacaaaaaccagatatttcaaaattcaagaaatatcaaacgctactaaatgatctttgacctgactatcatcgaaagagaaagttcgaacgaaaatagttacagctctattaaactgtagaatagcaagggaggttgggtttgtctgaagaggcatacaaaactttgatatattgaccccctacctaattgatccttcgataatattgaagaaggaaaaagaaagaaacaaactaccttatcgctccttctccgaaatattttttctcgtgaagatcatcgacatttgggactaagtcgattggaacaaggcctatggttctcttatccctttaggtctgcgctttttttcaccatatcatttctgtctctctatttctctgctgctcttcgtttcaatatttttgtcttagcacatttccattggtttcctcgtttctttaagttacagacatgttcattaaagtccggtttccaccgtttttgtctcaatgtgtattatcctacccccaagttttcattgtgattccacttctaatcactttcctcatctcgtattcgccattagtatctaaatcttctgcatatgaggcatcgaatacttatctttcaagaacactgtccacatacggaaatgtgactggttcctcagattataattactctctcacaaaagtgattctacagccagatgatgggtctaacgcattatcaaagtcatttcttatagactcgcttgctgcacaagcgaaaatcatgcataacatttcagacgacgtcattttacattcacctttcgacctttggaataacgatattgatctattgcgtaacgacagatcaccaatggcgactgtcaacggcaatttgcataagattcctatgttcttgttccaaggactggtaaaggtcaatggacgtgtttcctttgcaaatcgactatcgtttactattatgtcacagtgggataaaaatgatgtcatttcatcgcacctaagtcaaaacgttgaggagatgaataagattagaaatcaatcgaatttttatatcttcaccaatggatctacgttgctaccacaaagtcagagttcaacttcactagagaatactgaaatattccaattccatatctctaaactgaacggtttcgattttctattgattcttactatctattcccttatcgtatcgttctttatatataatatggaacatatgaaatctgtgaagtcgccttttggaatctcggtcgctatcatcgcacaattgattttgactttatacactggaaaagctgtaacatgcttttttttcaaaacttcgtccgataacataccatggtttttgatatacatcccaatcatgtttgcatcgttatcgaaccttttcaaattgaccatagagaaaaagggtaccattttcatcgaaagggaacccgtgttcattcagacaagtaacgatcaaactaatacacctccttttctctcctcccaacaagactttctgaactcaatggtaaaatcaaatcgtgacacattaagaacaacgttggctatgcttattctattggtcatcatcactccgttcagtagaaaagtttgttgttttttcattactgcattactcactaatttatttttgcagatcacttatttctgtgccgtgttgagtctggaccacagaagattcacttataatgagctactagcattgaataacgatgattccagtagcgatctcaatgtctccttggatagagggttggaagaaaccaattctagatggacagcttggattgaattgtttacagaattgaacgaatggcttccgaagtcgcctcttctatcaagatgttcgactttaactgccttttatatgttatatttgaacacaagattctcatcgattcgttcttcttcgtcaattttttacaaaattcttagaggaaagtttttcaatttcatgactttttcatcgccgttcacaaaagttgtcttcgataaacgatttgtttcaaatgagttgtatcgtctcagtggttctaagatatctagcagtaacgtactactaaacgatcctgttattgtcattaaacataatgctaaattccaatctttggacggcaaaacctacaaacaaattgctgacatgtacaattcctctccaatgaatacgtataagttcgatgtctattattttattgagttctcgatatttctactattgatattagtatcaaccttgttggttcttcaattgatcatacgaaaattggatcaccataatattaaactctatgaaattaatatggaagaaaataaaaggaaaccttctgcaaagggaacagcatttgatacatacacatcttcttcttcctcgtcaggaccagcttataaacaggatttaaacaaaaatgtgttccatatcaaagaactatcgatcaatggacacgaacttgatatagttgatatggctacatctaaagcaccgtttgtcgtttccataggtcttgatcacaaagttcttgtttggtcaccattgagtaacccattaccagctcctactgagattccacttccagttaaattttggccagtagtgtatactacgatatcgaataacggtacctatattgcttttttcaacaatacaggaagaatcacatgttggtctcgtaagacaatgtcattcatttggaatattaaattggaatcctttgattctaaacctccactagaagcgttctttagaaaaaagacggtaccaggcttcatgaaacgtaaagatgcgccaaagacatcatataacaacattggtatggaaagaaggggaagcgctatctccttgaagtctttggtgtcggtatcttctgcaacgtttggatcgagcggtccaggcgatgcgagttatgaaaatttcaatgccctctcctctgatgatgaaaacatggatgaattcattttcataaatgcatccaaccttatcaatgttatagataatcaaggcaatttaaaatcgcagcaaattacctcctcagaaaaccgtctcaaatcttgtaagagattggtcacaccaagaatgaatgaaagattagtattgtgtgacgaagccggagagttatatgtgtcaacagtggtaaacaataaatggagaacaaggaaactattggttgttagagatcgatttaacaagggtaaaggattgatgaccccacgctcattgaggatgaaaatgggtatccctgccacaccatccgatgaaacattgaatgattcatgttcctctgcgtcgacatttgaatcttctgaaactgataatacgttgttgttggttccttttgtcggtatggctgttaagaaaagcgggcgttttgccgaattgatcgacgttcaaagtggtacatcaattaaaagaattaaggtaggagatttcataccaggaactttaagggttttccatgaccaacccacccattgtaggttttgtggtagtgcgtctgttgcaactttatctatagcatacacctctatgaaaaactcacttattatgcattctttccaattggaaagtagaactaaaactagtatatgtctacgtgttgagcgtgatccacgtgaaatccgttgcttaggtttagagtcagtggtggagaagaagtatcatttgtccaatgtggatcgttgggatgtaaccgaaaataatactttgatcggtatcagacgtaaacctgaattaattgttgctaatcctgaacaaaaaatatcttcttcttcgatgttgcgttccatctctgcttgcgagtccgatgttgataacaaaatctataaaagaaacaacgcgaattgctcagctaagagattaagcaatttcgagatccataatgtttgggaaggatggacgatggatgccaacggtaaagttattttccatgaaattccaatcggaattaatggactcctagtcaatagaataggacctttaaagaaatttggaactaaatctatagtagttgggtttggaaacattatgaaaatgttttacctaggtcatgaagagttcatattggaagctgatgctgctggagtaaatgaagaaaatagcggattgcggtttgtcaataagagacgggaaaggttggttcacaagatcagtcccaactatgaagtaatgtctgaatcttagaatggtagacaagattaatgataatataatattaaacaccttatttatttatatttgtctatagttgtatccttcctttggaaggtaagttatataggctatcacacacgtaaagatttatgatactttttttttttagttaccgattgttgaatttgggatcgaaaagtagaatttgatattatatcgtgatttactcatggaaaaattattgccaaaagacaaaaacttgttcggttagcagttgttaaaaacatccaattgcatgttgagcatacgcctttggaacatgaattgaaagagagggaataaatatatagtttaaagttacaaaagaaaaaagaaaatgtgccaaagtgtttaacttttctcatctgacctggcgcatataatattacaaagtatcttgctaagtatcttacatgtatgttgataaaaacaagtgtattattttttctttttattttttggtcgaaggattctatttgattgggtgaccttcatgacagcaaacgatttctcttccccattcactattcaatatttgatcaccacttaaccttctgctaggtacaggatccaaaattgaatatatgacatttctgcatctagcacgttttaacttttcaatcggatcgtatccggcggcattttttcttcccttcaaatatttcagataaaattcatcttccttttgagctgtggcccaaagctggcggccggttctcatcgccatgtaaattacaccgcaagcccagatatccactgctcttggatcaaattcttcttgagtatattcttctggtgcaatatagggcccagagccacaaactccaccactgagatgaatctctttttcccatgccattctgaaacattcgctgttaccgaaatcagtgatctttagagtaccatcatgagtgagcagtagattctccggctttaaatctctgtggcaaacgcccatattatgcatgtaaacaacacctgttattagttgttttaaaaagcagtcagcttcttggtattctagtttccctgctgcgataatcaaagtgaacaaatcaccacctgagcaatactccatcacctcacagtaatcaccctttgcgtcttggaaaagatctagagtttctataatattggtatgcttcaaagatgaagagatgcagaattcagacgtcaacctcttcgaatatttcaccggattttcagtgggtcttcttctaaattctttaacagcatataaaatttctccactaacgctttttaagttcttcttgtgacaaatccgtaccacaccgaaggaacctttcccgataacttcctggcatctcccatatttctgcccaaaggtaacagacccatgatgcaatgggttgacagcgtcttcaaaattaagcatttttaagtctggttggctttgctcttgttttgtccccagcacttgtgtagccccactataaggataagcagtcccattttgaagttgataagtctcggcagaagcggcgtccacttgctttatgagacctgcaaataatgatggtggatcaccggatttcattgactttatgagtatatccggtacagcagatttggcttcaccacgtaatttttgtgcaccaagcatatttttaatcatagatcccaacttctcctgtctctttgcatttttcaaatggtgttcatgggtcccatcctcgtgcaggatgaacctacggtttggattaggacacgtatttgcagaggatagagtcgataagtttgccgttgatgatgcagaatggagcttttctgtactggaagcgatggatttaccatctgatgctagatgttgctgtgaattgaaatgcttattgttgtaactcgaactattgatcgtagaagtagctcctgaagctagtcttggggacgaaggtctggtgccatcatagcggtaccttgatgaaagggaagaagatgacgaagacgaaggtggtgaaggcggggaagccgtggtacccgttccggaacctgcagaagtcgcctgtgggacctgactagtactagtattgacagaaacattgtgtctcggaagatcttcatcaggagaaactttggacacaccaaagagtttaccaatcttagagctaaacgtgccctttcttgatcttgttctcagcacagaagcctgctgctgctgctgctgctgctgctgctgtaaatggcctgcctttggcaggccatcaactggatctgatggattcctgggtatggaagcagtaactgcggcggcaggtgctggcgcagctgccagctgtgatggcagcgtatcaatgctcatcacccaaaagcaataaaaaaaaaagatgcaataatttgtatttgtttcggagcggctggaaaatagccaaaaaagattggataaaaaaccggcggtagctttagaaactgtaagttctattcaaatgcaataaattgataatgtgtatgtattttgttgtgctgcttgtgttttttttgagcgaagagatgtgtaacggtgtaaaatttattgctcaaaatacaaaacttgtatgaagtaaagcaaattacaactgaaatttaaccaaataaataagtaaatgaaataaacaaaaaaataaagaaaatatgcaactctcaagcgaattaacaagcgagcgctcttttcgaaggggaaaaactttaaacaaaaaaaacttctcagagacttctcagaggaaaaaagaatctttaagcgggaattccagaaaaattgcaacaggtgagaaataggaaaggaaaaaaaaacaacagatagcaaaaggggaaaaaaattaaacgaccccggagaggattgaactctcgatcttgcgattaacagtcgcacgccttaaccagcttggccacggagtcgtatttgtggaatatcgggattttctgagtttcatattcgggctacctgttgtggtatatgactgtacatgtcacgtggcttagatcttgtcagatctttattagaagaattcatcttgattagctatctatctcctagtagaattagatgcacctggtgtctgtagatctgatccctactaattagtagattagatctgagtactggtttatatactttgctatgtgtcagtgacacaaaactatcattaaccgcctattatattggtatcacccggtcatgcattatgactagttccaacgaaatcagtgttctgcaaccgttgagcgaacctgtagtgcaaagtttttctatttctcaagtacagatccgcgatagtttaatggttagaattcgcgcttgtcgcgtgcgagatcggggttcaattccccgtcgcggagtatattttttgccctctaacccccccagataaagaatgccagacctagaatagatgtttgaatcccgacatacataccccattggtcagctctacaactgatctataaatgctttactacaatgctaaattactataattaattaatatctaagtcgatgtcacgtttatagaaagcttccgcgaacaatttaaacgttggctagcatgtctgacactgccgatttgaccttgtaaaatacgtccgatggtgaaccatcaactatggtttcggcatcattaatcttccgaaccaaaactttgccatcaatcactagtgtaccttcaccttggaactcagctttatgattttccgcagttagtcttcttttcaattccggtagtctaacatctccgattcttagagaacttccagaatgtaaagctaacgggttgcttaacggtttcaatataaccttctcccgatgtggggcttttgggtcagtttctgtcaatagtttaccaacaacgtgtgccacagtgaaagatttactgattctttgccagtttagaagttggtcgagcgatggatcgatagaaatatcaattgccttgacagatgtatccatctcaaccgaattattgaactcagtcaccaatatgtcaatatttctctttgttagattaaccacgacttggttatcaacaggagcagctgatggcagcacaatgacttttcttggtttgattgcaggccagatgattgctatcgaccgcgcattaactatgcttgtcaagtcgatatataccaaagaacaacgaatgttaacttttgtttccacaattgctcgtttataaatgtcacttttcaatgggtccaagtaagaaatatcatcattattttcttgtttcctaggattatgatctgtttttcttttctttgatttattaatccgcgaatcaagtacctcatatgtatcatcgtcatcgtcttcatcataatcgttattactataagattgctttaaagattgtgcttggtcatatgattcttcctgtggtaagaatctctttaagttgaccacatcaccgtaatcgtcagatttaagctttgctggatggaatgggaacataaggtgcttttcatttgtggaaacactatcattggaagtaatatctacgggaatctccactttaacgtttcccgatccattcttgcctcttgcatccattgaatccacaccttcttcgtcgctactctcatcatcaacatcaaaaagtattgtttttgtttgagctttgtcattggtcttagccgtatattcttcgataattttctctcttacctcatttctagttttaatcatttctctcaccttctccgcatccttcttgtttaaaattgttctcttcatgattcgaagtgacatcgaatcagatatgctaatggggttgccatccaatgcacttctactcccattctttattgcttgttgccatttatcattaagttttcgtaagggatgttgtgctggggtatttggatgtctctctgtcaatatgatcgttactttatctttagagcaaagtttgtttatcgtttgtgacaaaatatcatcaacttcggaaacaagacagatcttttgcccagtgtaacctcccaattcctcaggagtaataatcctcaatctagatacaacatcgaatggagaccgattgtctcgagattcccaggtcttgattacttgcgaggacaaccattctaacatagatttagcatatgtgagagaacggccccttgaataagatattagaaacaccggaatatcatacttcaatccacccctcatattttcatataagaaattgttaactaggactagtacttccaatagtttccctcctacttcaactggtaccagtaaagagttattcatttgtatagctcttttcatggtatcagtgaaatgttctactcttttcctctgaggttcagctgagcctataatagaaaggttggttattacagaagtcggatgcatcatggaactggttggatttccagtattgtctaataggtccgcactattcaagatagtatctcttgtatggttccaacgaggcgcatacaatattttttctgatgaagtgattatcgtccaaatggtaccaccgggagcataccctgagttatgtgcttctaatgagagcccatcgaatttattctttaaatccaccgtttgagagtatttcaccgtttcaatcaagtcaaaggagctttcaatatcttctaggtccatgacggcattagaaaacggtcctaatatcccaactgaagttaaaaggtcaacactgttgactctgcctagatttgatacaggtaacgtcccataaacttgaattctcgacctaaaatgaggcaaaaactgtttaaacatcatggcataggacccaaggcattcaattgtgggctgggaaatcagaacaatgtcaacttcagatatgtactgcgtccaaaactcttcacattcttcataactgccttcaccgttccatcctgggtccaataatactattacattgttgaatcgtacaatggttccctcaaaccgcttcttctcatccctacatgtttcgatggtgtatgtcatcttgagagcacagttacttctatatttgaaaaacaatgagaatccactggttggaatgggaaaggaaaaggtgtcctcagtgccggcaatctcttcttcttcttcctttatccttcattcttcaattatttgcatgtactgtttaaatgaacttaatgttgatgccttgagtatcattttgacatgttatgtccgggtaatgagatataatgtcagtaagaaggattaagaggccaaactgagacagggaagttgttattggacgagatactgctgcaatctgtaggttggtacggtccagtaggtggaatatcaaacatatttcattgcttacaattataggcaacaaaatccacaattttatcggtactttaagtgtcaaaatgtattccgaacgttctttgaggttgagtcagcatattaaagaataaagcgacagattacggaacagattgctcaactgacccaaacactggaagaagtctaaaggcatcttggatataccagcgtacttgaaatcagttgaattataaggacctagtttacaacgtgcaagataagctgcattagttgacacttttgacagatttgctaatgataagaaggaggagaagaagatttaagggtacaaaagtaatgagtcttccgatcgaaattattgatcgtgtagtaactagcggactagacagtctagagagtctgttagcatggagtaaggttggttcacattttagaacaattataaagcgcaagcttggtgtattgaagatttgggatttggatagggaatcatcaaaaaccttagcagatccttgcaattatgagttgttatctgatgagagaaacaccgcttgcgtaaatacagatacgttcaagtttcctgtgttgagcgaatttctacggaagtttgacaacgttctcattgtcatcgtatccgatcgctgctacagtgacccattggcgacggcattatgtgaattaagtagagggctaagtgggatgggtactctaaagaatctatgcttcatgtataagacgactaccaatttcctttccaagttctatttcagagagctaagccattgtcaaagccaactacgattatgtgaattacatatattcgccaaccgagatattaatcaccaggaagttgacatgtttgatatcgacacgatatttgagactacttatttacatgacgtggaaacgctgttcactttgaacataagaaggggtaagaaagtgattgcacctaggattatgacagtgaatcaattgcaatgtgaggataacactacaatagtcgatgatctacaatactgtcccctgcttaaaacgattgaaaaattccaagtgccaccaggaaagagagttgtattaccaccatgcgaccatttaactctcgtcagttacaatagtaacactgaaagggatcttgttgatggatccttcgtgagagaatctttgacaatcagggcatccccaatgtgttcagaagccaatttcaagaacatcaaatgccgcaacattcgatccctatgtgtcgaatttagtaacagtgtctggggtaacgtcaagttcatcgattgtgcttttgggaacctaaggtcttacaggtgtccagtgaatacagaatgggaagatttggtttattcaaactcaatttacgttgatacaatcatattcaaaatctcaaacatgctgtcactacagaacctcgcacagatcccattcacgttggacaacctcgtcttgaattcagacgacaaggaattgaaaccaccagaatgtaagccggatcaaatgagaagcatatacggttgtaaacaggtaatccaagaattgaaaaggttggaattcgaactttcaagcatctgggactgcgccgtatttcaacatgtgatcattccaaatctcacaaatgattctgaattgtgccttacgataaacgaaagtcacatagcaagagagctagagaaggctcgtgaatgggacagatctttgtatctgctcgaaagtttacaactagattggaatcgtaataagatacggttctgtatccctaaattgaaagcattccaattatctattataagagaaagaatggacgaaacaagagaacgagtatttcaattgcccgttggtacaatgtcgctactgcatccattactttctacaaatggtgccaactacgttaacctgtccgagcatgatgttatcgaattcatagatactaatgcataaaaatcagagcctacgtagtattttctaatgaatttgtatatatctgtatatgattgaatgatttagccgagtatccctataatgaaacctcgcatactatttctggaagcaccttaggagatcggctcacgatcggtaacggtcactgcagactattttctaaaaaccctaattgcaatctcgttgcatggcccagccatgccaaaagggcaggagattatgtaagcttacaaaggctaatctctcatcattaaagggaacatataggcattggaaaaagcacatactcctcaatcctaaaccactatcttacattatcgagctaggttcaacatatataagctcagatctactatatggttccgatttatctctcaaataacttttactcagagaggacccttccgtcattttccagtacagccctctctcagttaaacgactgagaagtaatattatcaatactgattgtaagagttatccaattacaaacagcccctgattcaatattccttaaacctgaagatttaagagactgtcattcatcctatacttgtcaggtacttgtatccatcgaacggctgcaccctgtgtttcattccaaagctgactgaataaattccgctagttttcaacgtaactaaaaacatttgccacacaggaatttaacagaattacaaactacttttacaagaattatgaatcaaaatgaaccgcaatcaagccaattctaatatcaagagtccattgcccacaagaagtgttagatcaaggctattcaagggcttgaggatgtatgaagataaacgttccgcaagtactgctgaatttgacgtcaagaaaaccaaattgacgaatggcttgaacattccacatatacagtcgcctggcagagccaggtctgcgactcctacactcgttcatggtttcatgaatgaggataccatgaaagagaggcttgcgcattacaatttagactttgtggaagataccgaggaacatcgggccaatatacatgatcctacatctaaatggttcggtagaagagtgaagcctggagtggaattagaggatcttttaccgtacgaaatcgagtcccatttagaccaggccaaatatttatatcacattgtgactaacttgtacgttgctatcaaatcaatggacgttcaaggcctcatcagtatcactagtcaagatttgttggcattgaagaatgaggtttatgatttggcattgaattctgatatgttccggttggttcaagacgttacagatgatccacatgatgtggctaaatttgacgaggatgacgaagatgactctatggagctgttggaagagaatgagtttttggatgctgcgaatcccgattttggtgtctccggtaaactcacagcaagatcgacagctgtaattaatgtcaatcattggactaatgagttaaaaaattgtatgcattttgagtttcctttaacgctacgtaaggcgctagcggtagtctattacaacttatgtctagtgaggggccaaaaggtgtacaggcaacttcatttagagatgtttgaaaaattagtggcttgcgatgatgaaggtacagactttacgagagaattgaaaaagattggacttgcgttagactataaaccaatgaaggatctcttgaacgaatttttgcctacagtggaacctgattataaaatgtacaatgtagaatcaagaagtgatttgagtttatttaggcttctagtcatgctctctactatcgctagaccatttttcgacgagaacgatgaaacaattctcacagatacaatggactacttcctagagtctttagcaccaaccactatgtcggttgcattaccatcacttacttgtttggttccttatcattatcacaagaatagaaatgtccttgactacttttccgtaatgttttcgctttggtcaaatgcaacggcagacaatagctttgatactcatttatacgcctttgttggacatgctgcgatggatgcatactaccaaaatattctggaagagaatccaccaataataagcaattcaaacattgagtttggcgaacatggtatcttcacagaatctcagcttaacttcattttgaatcgaatcaaaaaccatatcaaagaagattaccaaatctgttcattcactagagtagtgaggcctttggtttactctatcaatggtagaagcccgcaagctttcttcaagaaacttaatgaacttttatcatctattgaaacctatgttcacccttctaattctggctattggagtgatattattgcaaggttcattcatggtttcatcagaatgtaccacgaaagatatatgcgagagaaaaagcctgaagctaaatatagagaagaactaaaattagacgaggattgtcacgaaatgttggtgaactcatttattgagctactgttagtggggtcacaaagtaagcattcagatcttgctaactactacatttcttgtttcggttacctattagacatgaagccaaagaacggttacaaaatatgcgataggataatagtcgatctttatgatgctttgacggatcaatatgtcaattcagagcataggttgttaacatctttgaagcagttcaccagaatcgtcagagttttgattcaacatgaattgtaccgtgtccacataacgaacatcttatcaattctaattgacaaaatcgatttcaacgacatttctttgaccagcaatttaatgaatagtatagtatccatttcatgctttattccaatagaagtatttgtgaaaccggaagaatatcttacttttgaatctaatactataccgttcatcgaggaacatctatttttcatcaaacaaggcggttcttctccagatttcgaatacgaatcttccattctttccgatgctttcagagcttcaacaaccacatttgaaaactgcctgaaagtatatgtcgataaactatatcagttggttgatgttgatatagatgcagggctaatttcaaaaatcaaccaaacatcaatgattatgatacagtccatggatgataagatgttctattatttctttggcttattagaaaaatcattctgggataatgattcatttaaggtgaaaaaccctttaatcgaattagtttcgattccattgagtgctgccgtcaagagagacataagattgagtgctagactattcagggatttggatttcaatattagagagcagattaaaggcggagccggttcggtgagaagtacaacagagattcaaccgagagatgtcaagttggccactttattatcgactttgaacgatgttttaagacaatcacacgaatccatcctaatgttcggtgatgagctcattgctttactagaattcatttttgacaatgttacaaactcaccattagacgtcattaatgcaacgcttctacacaatgcactcgagagtttgaccactactgaagtcactgactacaggctctttttacaggatgccgatgtagagaactccgagaaatggggtggattccagtttgatagaagaaaatatttgcctgaatttcaacaaattgagtggcaccaaccgtcatcggatgaagttgattttgccatcaagttgattgatcacttctattgctatgctgtaggaatgacagagaaacttatggacaaacctcaaaacgactttagttatgttgacaatatgaaaaagaatattttgatcctaaccaatattctatcgggtagtagcatcctatatgatgctgattataatcagaataacaaatccgtcagtaatatggatccatataagaagaaattgttgctattacaaaaaatcagagatgaatcatgtgacaacaatgagcttcttgtagatatcgagaaagttagaaatgatacctttgacgcagatatagaaatggatgacagctatgttgattctgactcgcaaggaaatcttgatatcaatgctgatccaggcgctgcagaacacgatcaattggttgactacgaaactgaaccatcggaggcaccttcaggcattgccaccccagtgccaagaggtgaagaggattcaaactgttccatgatgaattctcataccgctttcagggatattgatgtgttttcgtacaattatttctttggaagaacagcagctgaacgtgcgcttgatcccagatactcaaaaatacatcatttgagacacgagattggtttattcttacacaagctcttcaaatttttaaatcaaaattatgagaattcaacatccgtattccagactttattacatggtttgaaggtctggtttactgatgttgggcaagaaactatattcattgatgatccaaaggcgtcgatatctgtggaattcctagaaaacatacaagacatagcacactgggaggaaccgttccttccatttacaagaacgtatctcgcagctgactgtcaggaacttcaccagtctagacttaccttatattcaactaataggaaaccatcgaaactggaattgaaacttttgaatgatgtcatttctttatctctatcggtgtatccaaacattcacagacccgcacagcaatgcatgattcatgttatgaaacagttaattggttcatattcgataatcgtaagaaaggttttcaaagcattcgaagctgcacttgacagtactgatgccgaagcttctaagaaattggaggttttgatccaggtgttatccatgaagaaaatacagagaaagatgatgtcagattataaaaatcttgagaaaatgctcactcttttattgcgtgcatctcgtctcgactcttacttcttagtctcactttgtgatcaagtcatggagagtgtgtcgggcctaatcaaaattccatctgctgtatgcctatttgacgaatctgcgattgattgcctaaaaccaaatgatgaaacaatagataaacaagttgccgttgttaaaacagctaaggataggaaacgaaaggagtatttctcgcaactcgaaaccttgcatatcaatcttgttgatttccaaaggaaagacccacagttgcgttggatgtctatttgtcacatattgcgtatagtgcaggtcattcaaatgaatttagagattaaacctaaccaggaggtgttaattcaaagtttcgagttaacgaagacaaaacatccatctctcatatcgaattgtatggtaacaatgttaaatgtttgtaacaaaatgatttcccttgggaactataactacgatatcgattccacctatcgcacagactatgtgagacaatatgtggaatacttggacacatcaaaaccaaactttgaggaagaatactttaaagaaattaataacgttgaaaatcctaacttttttgtggactccaaagcgtttgttggttggttatgccgaggaaggcctatgggcgttgtcaaagctgaaaatcagattccattcaaccttaagcccgaagatatggaaataatgaataactttggtaagctaataacaaaggagtggttgttagatatgtgcaacattttcatacggtccaatgaggagcaaagcagctttagcacgaatagattgagtctatttggaatctttgttcacttgatttctaataactgttgttctatgaagtacgaagatatccttgacatttgcgaagagatatatgaaaaagacgataaatcttcaatgattgcttgtagtgagatcatttcggggctattgttcagtttgaagtatacggatgagaaaaacttacagaagtttgaaaagttcttagaaaggtttttgggtaaatggttagacaacaactataatgccacaacaacggatatctggagcattgtagcttggtgggtaccatctttcattgatttgagaagatctgctcaaatatacaaaaggttcttgaccgtggatggattgtttgatgttaaaagtgaatcttcattagaactttctggtaaattgataatagtcacacaggcaatttcagatgtaggtttcaagatgggttctgttgaaaatttactcgatcaattagtctttgaccatccttccgacgtggttcgtcgtgaagttggtaaacttttctcagttatcttctacataaaggcaaatgctcatcgtccaaacgtgaagtctcttctcgaaacgggggcatctggtccaattgagatcagagaaatcccaagctggttgagagagagggctattaaaatcttcaacgaaattgaaaaagaaagattgttgatcaaggacctacccgctcaggacatcttgaagactaggtatttctacttggcatcaactatgttctattgggctgctcatttaatcaatactggtgctagagtgtgtctgggtccatttgctaaatgttatttggcacccttcttgatgaagttagacagaatgagagatgtttgtaaaatggtcaacattaaggtttacagtatttacgtggaacttgcatacattccaataagccgcacgttgttacctgacataatttcgatcttggatgacacagatttgactagctctcatgaattacgtgtgaatttgactttagcagagaaacttttctccacacaatcgttggttatggaccatgctggtaaagtgaagatcttagagttcgttttggacaaattgttctgtaagagttttgtagaggttcgtctcaaggcttcctatgtccttgccggtatcgtgcataacatatcttatgataccgatactttgcacactctcttggaaaacttcaagcgtcaacttggttcatatactttcgaggagaaagctgcactctccaaatccaacacagatattcacggtgcgatcttgggtctcggtgccatcatcgaagcattcccgtacgtttcaccgttaccaaattggattccagagaatatggcactactagcgtcctgggcaagaacaagcggtatgtgcggtgctgatgcaaagaacatcatctctagatacaagaaagttagagcagatacctggcatttggacagataccagttcacctcggagcaattagaagatatggaaggtgttctttggaggagttactacgcctgagaagttgcacaatcgacacagatgacccacaagctgcgtatgcacatgaatatatatgtacatctacaagtataaatcgtataatttaacttgacattgggtatgcctatcaccatatacgaattcgatcagtatctagattttggacaaatattgtttgaaagggtgaaagcaggatagccatcacgaaaggcactaacccaaacactttacggccgagctattaaaacccagattctgttgaccagatataaccagctcgccactcctccaatatatcgagataaaataacagtgttgaactgtgatatcaatttttttcacttaattgaagcgtgaaggaaacaagggagattgaaactataatgtctggattaagaacggtttctgctaacggcagcacgaataaaaactatgattctgtcatgaagattttacttctaggtgattccggtgtaggtaaatcatgtcttttggttcgttttgttgaagataagttcacaccaactttcatcaccacaatcggtatcgatttcaagattaaaaccgtagacatcaatgggaaacgtgtgaagttacaactttgggatactgctggccaggaacggttcagaaccatcacaaccgcatactacagaggtgccatgggtattgtattgatttacgatgttactgacgaaagaacttttgaaaacatcagacaatggttctccactgttaaccaacatgctagcgaggatgtagtaatgctgctagtcggaaataaaaaggacatggatacaagaaccgtgtcttacgaacaaggtgaagctcttgctaaggagctagggatcccattcattgaagccagtgccaaagacgacaccaacgtcagcgaaatcttcttcacattggccaagttgatccaagaaaagatcgatgatggtaagatggaaggaaaggctgaaaaggagggaaatgtaagcattcgtggctcaggctcttcaggctccaagtccaattgctgctaaaccacagatcagagcgtacaataagaaataacaacctatgcattggctttgtgtgtgtacatatatatatatattcaaatggtatgtattagaaagttcaaaggtaactttacacgaccattccaaatcaggtgatttacacgtgacgtaaataatcacatgaccatctccacgtgccactcaagatcaatataaaattgcccaactttcccaatataagggcatcgatgattatataaagagtgcattagaaggaaatgcaaataaagaaacagatataaggatggacttaaagattttatttagccaataaacagttgggtagatttctattttcttgttcagcttccttgtatcttgaattgagaagtgtaatcctgatcaccatcttcagctttataaccaggaagggttgctgtttattataacccttataatattgtcaaaagagggatttggtctttttaaattcaaggcacaatgctatttggtgtgaagctagctaatgatacttatcccccatggagggattcttatatcgattatgagaaattgaaaaagttgttaaaagagtccgttatcagagactctgaaatgttcaatggttcttcttctggccgtgggaagaaggggaagaaggggaagagtaatgtagatgaatattggagtgagaaggatgaatccaaatttgtttccgcgttggatgaggagttggagaaagtttatggatttcaaacttctgcttacaataagattatgaataccttgaataggcttgaagaagaaactgaaagtgaagagaatctacatacgattgattttcaggcgttccatcaacaattggaagaatgtttgagtcaggcccaggaattggacaatttccaacgtttaaatttcactggtttcaccaagattgtgaagaaacacgacaaattgcatccaggttacccatctgtcaagtcattgttacaagtgagattaaaatcgttaccgttccattcggaagaatactctccattgttgtacaagatctcttatctatacaacatcttgcgtaacaacttctcatctgtatcgaaatctttggctaactcatcaaaactttcctctatgccaaagaacgaacagatgtctacacaatccttcaaattctggattcatcaagataatttaatggaagtgaaaactaatatcttgagacgtttgccagtgttagtctatgctcaagcaccctctgagaacgaagacttgatcgatagattggagtctaatcttttgaatgacgacggtggtccagcaatgtccagttccagtaacgaaaccgatgtgggtcatttgaacaaaagttttgaacctgtcatctccacgctatatttcgataacgagttcttcgaattgtacaacaacaagttattgaaaaccaactctgctccaactttgagattgagatggattggtaaattgaacgacaagccggacattttccttgaaaagagaatgtttgtagacaacgaggattcttcttcgaccgatttcgatgaaacaaggattaagttgaaaccaaaattcatcaatggatttattttcaacggtgataccgaatataaggaaatgatgctcaagaaattgaaggaatccggctcaagcaacgatactaccaagaaattggaaaacaatttcgattccatccaacaattcattcttgaaaacgaattacaaccagttctaagaactttataccaaagaactgcattccaaattccaggtgatgaccgtgtaagaatcactatcgattcagatatcctttacatccgtgaagattcctttgacaaggaccgtccaatcagagaccctcatcactggcacagatctgacattgattctaacgtggcccatccattgaaattggttagacctggcgaatacgctaagttcccatactctgttatggaaatcaaagtgaagacatctgcgtcttctattgcctcatccgagaatgcactaagcgttctagcccatggtggtaaccaagtgaaatggatcgctgatttagccaattcccatttggtgaaagaagtgccaaagttctccaaatacgtacaaggtgtggcctcattgttcggtgacgatgaaaaattggatatgttaccattctggttaccagacttggaattcgatatcagaaaggatccaaaccaggcctacgaggaagagaagaagaaattagaaagacaacaggagcatgtcgccaagatggacaagatgaagagattgtcagtggtagccggtggcggagaccagtcttcaccagctgcaccatcgacaagtgccttgaacgaagaagacgaacctgaggaagacgaagagtcttccgaggatgaagattctgctaccttggccagaaacaaagggaaatcagatgcaagaaaacagaaacatcgtcatcgtcatgaacctaacattttcaatcttttgacaggtagagacaccactgacagcaaactcaccggtgtcgattctgaagacgaagaaattgaattaccaccgggtgtcaagaaaccaacaagttacatcaagaacgctggtcctgtgaaagtcgaagcaaaggtatggctagccaacgaacgtacgttcaacaaatggctctcagtgaccactttactcagtgtgttaaccttttccatctcgagttctgtgaagaaggcaaacatgccattcttggccgagtggttaacttacatctactttgcattgactgtatttactggcctatgggcgtaccaaacctacatcaacagaataaacgtcatcagagcccgtagtgggaaacaccttgacgcaccattcggacctttggccgtctccgtcatcgtgtctactacgctaataatcaactttgtcgttgcattcagagaattaatcagaaatggccacactgatgatccagctactcctgcgttcatcgctagcgccgtagaaaccatcggtagaatcgcgggcccatagttcccaaattgaaaatagacaatagacaatagacgagagagtgtttttattaatttatacacctatgtaaactatcattccacatcattccatctaataaaagttaatgtagttaatgccttgataatagaccaatggtatgtccacttgtctaatacctagtattcatagctgccaaaatcagcacgtgaccaacttttagttttttgatcgacgatatttctcaaattaaaggcacgtgactagcggttcccgactcgttccgaaatcatccgaaaggaccgaatgaccgaaactgggaaaccggaaactttagtttcaaccattagaaaagtatataagggaattagttaaagaatatactcatcaagacaataaagtctgtttactttcttgcctgcttcatagacaggtcttaaaagtccgactggcaaatatttctggtattttgttaggaaagcaggagttaaaaggcatacatacagttgttattatcaaaccatgttcaaaaacgttttgaaaccaggaattgttagtggtctaagaccccaagttatgacctcaaacacaagaggtttgatggcttcttttattcgtcgtcagtctaatgtcgtcaccaagaagactacggctcaagaagagtacgagttgctagtttctcagagaaaagttagaccagtgtctcctcatttgaccatttatcaaccacaattgacatggtatttatcgtccgtgcatcgtgtttccggtgttttcttgggtctagcgttctatgcagtaactattgcgttcggtgtttccactgtgttcggtctaggaatgtccacagagaatttggttcaattttataacgaaaagatcccatcctggattgatttgaccgcaaaggctgggttcgcatacttgtttgcattccatttcggtaacggtatcagacatctgatctgggataccggtaaagagttgaccttgaaaggtgtctacagaacaggttacgctgtgctaggattgactgctatcatgggttcttacctattaacatggtaagaaaattttctctgttccctcacagacgctttactcacacattcctttctcagtatgtacacttctctatatcaatgatccagttatttatttattctaaactttgaaccgcttcaagcggctgtagtttcatattcttacttccctttcttcttcttctcttctcaatatactaggtattccatcttttcaacattaaaaactctttatacttaaatacattgaaaacttatcagttatagtttggaatgatgatgaaatggacacaccacaggccaaacacaggggtatccatgagtcagcccaagattttcaggaagaagagacaggagtctcgttaccacggtgggtcgcagtcgcggtaccagccaaataggcctaataatcatcataatacagctggaaatgttaacgtcaatcgttctttggggaaaagaaatccaagaggtaagttcaacaggcccagtaatggacctgaaacgagtggatcgaggttcgaaggtcatggcagtatacctaggggccccagggctatggggtcaagtgcagaaagcgctggagattctcattcaagaaatatttttggcaagaaacctttggcattgatatcgtttcaagatgtgaaatccagcttccaaccgttggcacaagtcggagaaggtacctatgggaaagtttataaggcggagaacgtacatactgggaaacttatcgctttgaagaggcttaggttggagcaagagcgtgatgggtttccaataacttctattcgtgaaattaaactattacaacagttgaaccatccaaacattagtttgatccatgagattatcgtatcggataaaaatacaatttctatgggattccagtacatggagaacgatttgtcagggatgttaatggataaatcgatccagttttccgattccaacattaagcacttgatgaagcaattgttcgttgggttacagtatttgcaccaacagcaaatagtacacagagacatcaagggatcgaatttattgatagataacagaggtaacttgaagataacagatttcggtcttgccaagaaactaacggacgtttcttctccagcctccaataccaacagagtcattacgctttggtacaggcctcccgaactacttctaggggcaacagactataaatacgaggtggattgttggggatgtgggtgtctcttagtggaattgtttgcaggggctgccatattcccaggttctaacgaagtagatcaattccagcgaatattgagcatcatgggaagtccgactttggaacaatggcccaagatgttagatatgccgtggtggttcatgcttgtaccacaaatatctaagacttacaagaacgtattcttcgatgagttcagcaaagtaccgcaggatgccctagatttggcatccaaattgttacgatacgatcaggatacaagattcacgacaactgaagcattacagcatcattacttcacaaatgaacccaaaccacaacctctactcttgggacccgagttcaaaggttcgcacgagtacgaagtgaaaaagatcagaaggaaggagcgcgaacgccagaaggagaccaccgtttagagaagaagcgggggttttcctttgatctcattttctcattttctcatgatccatagatattaggtatacgttcatatatacatatagtgttacaaaccgatatttatcgtaggcatgtatctcatacctcatttctttaacatttcatcttcgaatacacggttactgccgatgaaagtgctggcttggacggctcccagtttcgttatcatattgctttggtttgccatgatttccacttgagccgttgtctcatcgagattctcacgaagttgtttcaaatgtgctgctagtctcgcatattggcgctgtttgttgtccatggtaaatatcagtaacgtggatgaccttccgagtaaagatcttgagcaatatcctttggtacttctgttttaaaggttctctgctattagtggatgcaattttaaagattcaatgttttgatttaagtgaacacaattgacaatctcatcgaattgaatcataaatagatgtgatatatgaaacagtactgcacagtactgagcaacagtggatattgcagcacccaatgtcacggctcaatgatccagtagagcttttacagcaaacccggtccaatttcatcattgaaagcgatgtctctaatattaaagagatcaagagtaatatgagacagctcacgaaattgatggctgagaaacaaacacaccacaatgagctcatgaaacaattgcaatcacagctgcaaagacagcaaactaaagtgcaggcacttaaaaagaattttcaggagcaaacaagccaagtgaaacgcgtagaggacgaattaaacataccgaaattgcaacaagacatagataaactggtacaggaaattaaccagcttcgagatacgatacaagagggtattcaaaaggtcgtagaaacacagaaacaattactcaatgacgatactgatgctgcccacacgattgatgaggaaccgatcggtaaagatgacaagatacgtgtgctaaagttgaagttgttccattcccttgacgtagcactatataatgaccaattgctcgatctaaggaatgaagcccgtccattatcatcatcatcatcatctcacaacatctgggatgaactatgataccttgattttattcactatgtacaggggctacttactatgtaataatagaagtttttaatgatgattcatccaaatcagaaatgacgtgggtttcttctgatggaaagcttggtccatttgggaactttatgtataccctttctatatcccttcgagtacctgttgaatacactgtacttatcagtagcagacatctccggttcctttgggaaatactgagccttgtctaaaatacgtaagctcttcacacgaggtttaatcttacgtagattcagctgagatccctcagaaaccgccatatggtttctttcaagatgaagacctaacttaagagttgaaagaacatcatcaacgcttctcaaacggtctctttgtcttgctttttgaggaccagacatacgccatgggactttccataataatccacctaatgcaggttgtgtagctctgaatgcaccgaacatttctctatgaaacaaagatattcaattgacccgggtatgacagaacctaacgagctgcttaaacagtttgtataacggtgctactggctggcttttaccaatttcccaccgtaattcatggtattaaatcttttaaaccttcgaaatttttcaaagtatccatgaaaaagctttaaatctcaacattatgcaaatgaacaatgtcaactgatttaaacgattttggggaacagccagcgtattgtcatttgtagctgctgctgtgtccataaccataggtcagaagttcttatagtactggaatactgcaccacaaagatagattattcatttagaaatgtcagagggcgttggaaagcataatcaaagattaccaatttgggtattgaaccctaccgaggagaaagaagctcgtcagaatttgaagaaatttgcatatgcacaatgtgtagaatacgtggaggccatggtcgaatgttcaaagattcatggattgaagcttttcccagcgtgtaacgaacctcgtgacgctatgcgcaaatgtatattatcataccagaaggattctaatctggatcgtcaacgtgacttgatagtggaacgtaagattgagagacttgaggatcttctcaagaaacaaaaggaataaagttgacatgatatgacatgacatgacatgccactggggttacttgtatatagtagtagatactgcaccataataaattaacattttagaaaggcacatccatgattgaagtttatctgcttcattgtttcccattataattatagtttgtacaggtgttcaaaagagtaaactagtttacattaagtctagaagatcggttgcatgggaattcgaggtgttgttgttgttattattggttttctgtgaaatgtttactttccccatatcaccagtgatatcgaaaagatcatttagttcgtccaggacgcctgtacttctcgtggcagagctatcacccatgtcaagtagtacatcatcgttcatgtttttcaggatctcgttcgtggccattccctttaattcatcaatatccttatccttaatgatgtgaacttcgttgggacggcgttgcatctgcgagattggtttgaaatacacagaggatagagtggagagctcttgaagtagactttgtaatgtttccttggagaagtggtccaaggtagaatgcaatttaggaatttcatgcttgtcaaataattggttgatgatttgatcaccgttgtcgatcgatagacaccgccagtacatcatggccatgtctctaacgtccaaatcgtggacgtctgtcgtacaaagttccaagatcttctgtaagaaagcacttgagactgcattatggcatttcactacacccattagaagggacatttgagttagggatcctaattcatcgaaaacttctaccagtggttcaagcttagtttccaaattttcgtttgtatagttggtgataaaccagatgtagttacaactgcctagatcagatgtaaatatggtatcgatatcttgccatgaggaaattatggcacccaactcattcttacttgtttccttgataagattgttgtcactgtcataacgtaacatgtcgcatacgcatctcatcaatatatccctaaactcttctctctcctggacaatcgaaacgaattcttccatgaccatattcaaaaacttgttattcgtatcttcacctccgttcgagactttaatggccaattgtgagatggattggatagctttggtcacgaattcatgatcaaagtcctttgcatattcttttaattcgttgaaaagcatctggcaatgtttcaaattatccacgggcactaatctgagcaagatgtctaatttctctatcttcacgtacaatggatcattaaatttgacatagaatattcttaactctttccttaacaagtttgggaaggcatccaaaataattcttatatttctcaaagcaacatattggatctccactggggtcgacattagtgagaccaatgcagttgataacttgttgtatatagagtcatggactgtgttcaaatttggtagatgtatgagtatacatttaacactgatcaagaccactgatggatttacgtgttgcaaatgtggaacaactctatcgataatttcttgagactccatagggtcaattggtttgtgttcgctcaatgactccaaaatagtgattcttgcccattctgtacattcgttcaacacgttcaaaaacctcttaacgttttgagatactaatttcttgatatctattgaaccagggtccaattcgttaatttcgtgcagtgcggcaagcgcgttggcaacaaccattggattatcgtcagacaaagcgtcttgcaaatcgttcaatacgcccaattcacggcataggtccgggttcaattggaacaattttgcaacgcatagtaccgcggttcttctcacgtacggattatcatcgactagagtctttcttagcggaatctcaatgtattccaagatcttatcaactctgatcatcgacatggtacggattgccatagacctaatcaatgggttcggatcagctgcatcgctgacgaatgtgttcacgacaaggatgcataactccggatgagtttctgcataattagccacgtaaaggtataccaatttcttctgttcaatgtcttgagtggctatattcttcaaaacgtcgggaaacaaagatgaaacatctttgccggaagtcatctgttgaataatcttacggatcgcgtcctttcgggtctgtgggtactgagatactaatccatttcgtagttcaaacaattcacctttattggaaatcttaggagccactcgtatggcgtctcttaagaacttcttgatcttcttatcaacacccattgtttcccttggtatttatgagaaagcagagcaagcaattggctggaggaaggaagactaatcgcttggggacagagtcttgaatataaacaggttcatctatttatatacagattccagttaatttgattgatgttttctatgaatactggaaagtgaaagcttgctggcgaggtcacgtgtgtgctcacgtgtatcggaagattccgtaacccggacatcatatgatgtccgggttacggtattgagagatctcacttcctaataagaatggttactacctgattagggaaattgctaagggagattcacacttctgcgtaaattcttacgcaccgcagtgtggtgtactgatatacccgactttttataaaaacacagtcctcagagttgccagaccaaaagatacgcgcgacacccttacaccattcagcgtaccactcagcacgcaccacgcacattgaaaaaaaattcttttctagccaaagctcatcacttgaatattgagaaagtattaagaacttgatataacttgcaagagtttactgcattagtattaagctatcagttcttgttgattgaaattgttatctattctcttcttttgattcatcagaacaacacatctcaaggaattaactgaaaagaaatgtcttccagcaatattatgcttgttttgagaggtaccctagaaggtcacaacggctgggtcacctctttgtctacctctgctgctcaaccaaacttgttggtttctggttccagagataagactttgatctcctggagattgaccgaaaacgaacaacaattcggtgtcccagttagatcttacaagggtcactctcacatcgttcaagatgttgttgtctctgctgacggtaactacgccgtttctgcttcttgggataagaccttgagattgtggaacttggctactggtaactctgaagctagatttgttggtcacaccggtgatgttttgtccgttgccattgatgctaactcttctaagattatctctgcttccagagataagaccatcagagtttggaacactgtcggtgactgtgcctacgtcttgttgggtcacaccgactgggttaccaaggtcagagttgctccaaagaacttggaagacggtgaagtcgatgacggtagaatcactttcgtttctgctggtatggacaagatcgttagagtatgtgccagacttttttcttttattgcattgcattgcattgcctatctcccgattagattgatttaccttggaattcaggtcctcagttgtttccccgtaatatattctcaaaatacatggctcaattcactatactatgacaaatgatgtttcttatatttgctacttcagacgtaaccttacatggtttcgaatgagacatactaattatcaccaagatctctgatgtctttttaattagtgaattaaaattttgaattgagttttgtgcatttgaatatcatggagcgagcaatttgggcctgtattcccagatatatctcatggctttgaaccaaatatcatttttactaacaatattttgggaattatcttccattccccttattaactacagtcctggtctttgaacgaagactcttacagaatcgaagctgatttcatcggtcacaacaactacatcaacgttgttcaaccatccccagatggatctctagctgcttctgctggtaaggacggtcaaatctacgtctggaacttgaagcacaagagcgccttcatgaacttcgacgctaaggacgaagtctttgctttggccttctctccatccagattctggttgaccgctgctactgcttctggtatcaagatctacgacttggaaaacgaagtcttgatcgacgaattgaagccagaatttgctggttacaccaaggctcaagacccacacgccgtttctttggcttggtctgctgatggtcaaactttgttcgccggttacaccgacaacgtcatcagagtttggcaagtcatgaccgccaactaagttgtagcaatttaaaatctcttaattttgcttttattccctacaatttattcttggtcgtcgtcattaccaataaatcataacataaatcccttatgtatatattagttatacaaaaacttacattataatattagatctcccctcggttaatctgtcttataagagttccgatattgttatcttagcttattattatgttttcaatggtttctacctatacatgcataatatgcatttcggttaggcaaaaccgtggcacagggctattccaagggcaacccggtaccttagcttccctttcttcatatcaccctttctttctctctcttcctggcgaaaacgcagaaactcgtactctatctataatggcaattctatttactttttgaacttttaccgttcactttaaacctctttgcaaaatattccgtttcaattaaaatttttcatattaacaaacttaaacttacattagcttaggttggactggacttggttcttctactgctcatattgtttttgtgtattcagattatatttgctactgtaaattgtaaattgtaaattaaaccatttgtttctttgttcgttttaaaaggtacaagaatatcactctaatatttacaggacagatcatatccaaaaattatgtcatcttctgctgataattccaacaacagtagcagcaggttccctgctgctgttgactctatcaataacaacagtaatagtattaacgatgctagtcaattccacaacagttataatgaagtaaatgaaattaataatgatactaatagccaagtgaacaacggtaacaatattacattccacgtccttgtttctttgaaagaagcagcaaagatcattggccctcaggggaataccattgagacgataaggagggaaaacgatatcaaaatcggtatatcacctcgtgaaaaatcatgttctgataggttattgaatgttagtggtcccccaagacaagtggccaattcgttgggtcaagtattacgtgtgctaactacggattacgagcctgaggaacacgttttcaagcatctaagattcatgttacctccagcatcgaaggaagagattgaggatccagagaaatggaaacaaattggtaatttgagattaatctgtaccaacccacagatttcgtcagtcattggccaacaaggtgccaagattaagaaattgattgaaacgcatactgttaaactcgttgcctcgaaacatttcttgcccgattctaaggatagagtattggagattcaagggttccctacctcggttgccaactgtatcaacgaaatcgcagaactgttcattcaagacgacgtccatgtacctccaagaactttgccccgttactatcctcattctaaacatacaaaagagatccaagtgtctcaaacgttggctattccaaaagaatttgtaggtgcacttttgggagttggtggtaaccgtattgccaacttgagaaaattcacaaagactaagatcgtcatcggtcaagatccaactgaaaatggtgacagaatctttacggtttggggtaacgaccaaaaatccgtcaaattggctcagacaatgttgttaaagaacttggaagttgaaaagaagagacgtgaagaacacgaagcctctttgaaggatggttcatctgttcctgctgctgctgctgcttccgccgccacttctatttctgcttcaggggctaaccaaaatgactctattcatactccagtctccgataatgaatctcctgtcgtatttacagaataattagtttacgcttttccaccttttgaaagaagttaaaactacattataatagtatttttttttatttcgggcgggttgtttctttacctgtatctcatccacccaactcactacactccaaaagactagactggcttactacgatatcttctttcccaaccacctctttcgcacagagaagcagagatgttatttgccgcgtgtctaacgagaaagcgattgctcaaagacgaagcgtttattggaaatacgacaccagttcactcttgatttcgaaatcaaggttcctgtatattccaatttgcttccaatatacttgcttcgtcctatagtcacctttcttccctatcagacactcattattttcgacctttgtctttctccagtagagagaattcaaatcctaataaaagcatcatccatttctgttggctgtttatgctctcgtttgtgtgtcgatttatgtaaatcagactttttatgtaacagtatatccacaatctatttttttcaaaacgaaaccttcttctcgtttcctttaaaccgttcctttacttcgtttaacaccatctcatctcctctgcctcttctgattcatttgggaaaccaaaacatcaaaacaataacattaaaaatggaaaaattgtaaagatcgactttaagatttaataaacagggcaaagtggttgagacaaagagcattctgaacgttactgcaacccattgggcactcacatcacagcgtttgtctgtatagaaacgaatactgcatattagtaccattattttctcattgtatacaccatggacaaggaaaatatgccacctttattggatggccatcaaatgattgaatacatcggtgtgtcaaaaagattagggaacaatgtcttacaggagctggaacaacgtgccagtaaccttctaccgaacgtgtcaccagaaaagacccgtttgatgcatctgggccatgattcagagatgaagaattcgatttcaatgaagtttcaggataaacatgaaaaacggttccaggtgatggactctatcgatacccattactcgctggctaagtactctggtatgcctcagacaccagggaagaggaaaaatgggtcagacgcggatgagacaagtgttgctgtgaatttaggttcaccaggatctgtaaagaagaaacagaaatccgtaggaaatgtgttcagtccggttactgatataacgcataggatcaggaggttaagggtacgcattacgacgcccaatgaaagggaaagaactgagcgtgatcgtagaagaaatataataagcaacacgccgttatcgagacagcgacagctccatgaaagtatccctactttcgcacaacctacagctacgtcactgaaacggaaacagatgaacaatcctttacacaagctggtggctagtgacaacaacaatgtggaatcgcaacccaaaccgaaaccagcaaaaccaagacacggtgatatattcaggaatttgaaccaatcggagaagcaggcctcacatccgagaagtgcgccggtacccaaacaacaacgtattcctcaatctaaatccgtatttgaaaggctatatgaacaatccacgatatccagatccaattcgtctaaaaatttactgaaacaggagaaaactactagtagcgatggtaacacatcgcaaataccaagatccaagacacaacatgatttacatggaggtatgaaaaatgcaagactaacgaaatcgacaacgctgcaaaacgttgcactagatagacctcagtggaggtaagtaaggaataaatagactctttataaagataatcatgaatgttaatttgttatgttacgtgaaagtagaaatctatataataatgatcaagcgtcatgatcaaacaatgaaaacaacagaatgaaagagcaaaaaaaaaaaacacaaccaaggcaaagtaaacgtgaaacgggggaataaatttacagaatatttattgagatagcaaagaatattaatcctcacagtctggaatctttttgctccttctttgacaacgattttcagttttgtttttcttttagtttgccattttgattcattagcgttccatgagtatgttaacttttttgtttttatgacgatgacattttagaaaaagattgttaattcattattgagaatatctgaaggaatttaaaccccccagaaatagccaacattagagttcgtatcctttgagaatgtgggggatagattcaattttttttttctgaacggaaaggtgagttaaaataagcaataaaaaaattaaaaggaaagaagtttacttctaatttgcttatttgaaagtcttaccgaacaagataacttgcaattgatcgtacatggagataacaccggcaccggcgacacctctcaagatgttagcaccacaacccttgaacaaggacttgataccttcagcagcgacaatctttctgaaagcatcgaaggcaccatcatacttgacagcttgaccggaagtcatcatcattcttcttctaacggtatccaatgggtaagaagcggtagaagcaccagtggtgacggcccaacccaacaagaaggaagccaagaaggagttttccaaagaaccagtcaacaacaatggtttcaaagaatcgtacaaaccgaagtacaaacctctgtagacaacaataccaacaacagatggcaagaaacctctgtacaaaccagcaacaccatcagaagccaaagtcttcttgtagacatcgactagaccgttgaattgacgttcaccacccttcttagcgctcttggagtcagcagccaatctggttctggcgtaatccaaagagtaaacgaacaatagagacaaaccaccagctagaccaccagaagccaagttaccagcgaaccatttagcgtaaccttcttccttcttgaaaccgaacatagccttgatcttgtccttgaaggcaaagttcaaggcttgagttgggaagtatctgataacgttagcagtgttacctctccagaaagaagcaacaccttcgtcagcagcagttctcttgaaacattcaacgataccggtgtatcttctgtccaaagaaccttgcttgatcatttcatcttggttttgaatcaacaacttgactctctcaattggagcagcagcggtcttggaaacggcggcggaaacaccacccatcaagaaatcgatagcaaagttggattgtttcttgtcagtagacatctttggtacgttgttagttatcggttagggacggtaaaataaacaactaaaatgaaaagttaaatacaatagataaaactctactaatgaataaactgaatcaaaaacaacaaatatatatatactccagtcttaatacagaacaaggaaaacctggaagaacattgattcttaaaatttttcattcgctttaaatatttttttttccctaacgttttcccgttaaaaagaaaatttgaaaaatttggaaattaaactcagtcaaatcaaattgaatggaattggatatggtcaagatatacatacataacacaggataaaaaggtatatagcatagatatttggcattttaacggtattaaaaagaggaaaacgtcaagattcgatatggcagagagtctgtgccataaagaaacaagaggaatgggaaaaaaaaaaagaatttttttttttttttccagtgtgtttctacagtaggaaaaaccaaggaaaggaaaatgaggaaaaaaagaaaaatttcatggccatgccctatgaaacgttaattttggtaaatttaccatacaaaattgacgattttttgtatggtaaaacttattttttcagtttttcaagtttcgcgggttttttttttgtttcttgaagattgttaagtaggaaggaaggaaggaaaatggattaacgtgggatttgttcgatctggattatttcgctcattcggtggaccctcgcctgggtgacttgggacttaggacttgggactaagccaggcattgggctggcctggaaaggccagcctagtgtaatatccccaaaactgaggcagaggcagaggcaattctgcctctgcctcagttttggggggatgccacttgttaccccgcgcgcagatgatcccgtccccgggtttctaacccatacaccacacggtatctcaccctggaggtatttccgaaaggaaaatgttagcctccacgaaaacggacgttctgtgatgtgctatttgattggttcgtgtttcgtgatatgaaacaaaaccgggtaaccatggcgcacgtcctcaacgaaagccttttattatgtataatatacacacacacacacacacacacacatacaaactacctagttggcctgcctagccgtcttgcctacgcctgtcgcaacttgttctgttcgttcatcactttttgcaactgttcctctgtcttgaagtcttggcgccaattacagatcggacaatgcaattggttgccccagaaaattgggcacaccggcacgaaccaaagtgagataaactctcttctcttgaccggcttcacttgaaaattatgacaatttgggcaatatatcccactgtactgagactccaatggatgtctggaatcccaatcttttttaccaaagatgatcggtacaaatgacattgcgggttacttagtgtgtttcgattttaagggtcctggtcgtggggcctgagtcctgcctgagttcaaagtccgagcttgccaggatgcagctcatatatatatatatatatatataccaattagtgggctttgccatttgctagaggctctatttcctgcacggtagtttctttttcgtaccctttttttttttgctaattacgtagggatgtgcaagtgttacccggcgcacgccgggtaacacgactcggttgtcttgtgcgatctcctccctccctctgaacacgtgccgtgttcagcgggtcctatgtctcaaaaaactgactcgggatttcctttcccaaaacggaaactccaaaatcgccgtccgcccgttatccctatctcgtatcagtaaacaggtaaaataccttcgcaaaaacctaaacagaaagtgcggccgataagatggaaaaaggaaaacaacccagtctacgtgctttgtctcctggtctgtctgacttccgattgacttcgagatacttttttgttttcactccatttgccttgttcattggttctgcaccgcgacagctgggatctagtactatagtatttgggaacggcgaacgacctccactttttcccagaccagtttcccactggaataaatggcaatagctctccatctctgtttctccgtctgatatctcactccaaaatctcgatatcaattcgctttcgtagtcatacatgtacggatttattccccttttcatgcatttttctcgaatcctaatctttattatactataatagatatcgtttttctttataaccttaaattctatactgtgggaataagagaaaaatggtgtagtcatatacagtgtgggtaaagagaggaattcagcagattactgatcttttacccatagcttgctgtgctaatatatatatatatatatatatatatgtggtagcattggctcttgtacaattcaattgtgttctttctctatttcttttctctatatagtttgacacatttccaatgtgtcttaaattttctactgtatctattataacctttttttttttggtttgacatttggctggattcactataggattgcgcagagtcatggacacctgaaccatatatacttatactgttctatctatcattgtgtgcgtaatgtcgtggtctcagggaaatgtatcagatgtgttcagtttaggatacgacttcagtagtaacgttgcgtacccgaatttgcttttagatacggagctcgaatcaaatttggagtcagatgttacggatgagttacaattacaaccacaggtgtcggacttttctatgtctttagctgatgcctacactttcaattataccgataatactactgccagtgccagcagtggcaggattagcaatgctagttctaccgctggcactggtgacgacactgccgagacagcgacgacgacggcgacaacgccgctaccccgtcaaagacggtactcgaagaataaccgtcaaacaccaccatcttcatcttctgcatctccttgcgggaacccaaactcgcagtctggctcgatctctagcaattcgtcgaaaaaagtgtctgattcaaggctctcggcaagaggattggctgaagtgttgaatttgagttcccccgcagaagcgttatacagggaaaaatttatcttggacatcttcgaaaaggaattgcactatccattgggttataagacttgggtccggggtactacaaaggagtatagaaccaggattttataccaactgcatcagcgcgttaagaccaggtatcccgagtacgatgaaaaagtgttagagatcatcatcagaagagccacttactatatgatgcaatcaaggttaagacgagaacgtagagccagagccaaggcaaacaaatcgaaatctacacaacggatatcgaaaaacgattattcttcttcacggaacgcaggaaacgaaaatggagacatggacgttactagtttcgatttcggtgtcaattcaaattcgtttgtcacaggaaacgctttcttaatgtaaagaaaagaaagaaaaataaaacaaaaagcctggtgcttgcttctacatccttttttccttcatttcgtccccccgcccttctcgtcctttctctttcatccaaccttttctttataacaggtttataacgtcgtaaataatatcatcaaatatcaattcaatttctaatatacaatttaaaaaccggcctattatattaaccctggataataaaatgagaaagaagataggaagagagttaacagtaaacactcaaagggtataccggcaccccaccctgtcatttaaaacttggtgaatgaacccttcttattcttatttttttgtaaccttgccttcttgtaattatggtgtctagcgtctctccagccagaggtactgactttcttttctgagtcctcgccagattctagtttttcttccttctgcagtctctcctgttgcagcagggtctcctcgtccacttccataccgttgttcttggctttcaagtcatcgagcttctgcttcaacaaatcgttcttcaacttctcggccactctagcagctctggcatcgacagttttttggaaaacacctttacgtttgatagccttggcatttagatgggaagatgcacgtatagatttagccatggtgaattatgtactagttggttctcgagcttcctaaggggtctataaatggagcagttcacctcatctcaacttatctcatcccatctcatagagcaagtacatcttagtcgacaattaaattttcctagagtccatatctctaaacacgtttctttttctgcatggactgttcttgtgactgtttacatccgtacattatttgtatatttatttcaagatgtgtagtattttctcatttcctaataagggaatgcataatctggaaagaacatgaaaaacagcaaagtctgggaaggaagagctctgatggccagagctgtgatgggggaatcactgtctggagccagactccatctccccgcctagcgtggaaaccgagacctgcgttctctgcctaacgtagttccctcctgtccctccacccagcgtagcctagtactccttactgttgaccggtgtgcccaggatggttcctttccacctagctcgtccctgcccgaccctgtagttgcctcggctcactgcgatgcgttctctttccattggcgagtttcgtatcctttctatactgagtaactaaggaaagtttggaaaactctttgttgaagttaacgattgatattatatcaatatagcatacgttattaagatataggcttgatttagtgatttataggttacttgcttattccatttgaatcgattccaacgataacgaaacccaagcaaaaatgtatgttcaaagactgtggtaacgaggagatactagagcaccagcagaaagacggataatctagagcatagataatgaagatacgcaacttaatggatagagaatcttataacattcggtgatgaaagcaatgccgatgtgagaactataatacaaacaccatactggggaattacggctattaaagacctttaattttggaagaattgaattgatgttggaagacttatgtgttttcatactttgagatgcaggatcccatgtagaactgcagtgattataagagaaatatttctaccttcaatgattaggaaataattggtgatacgtctttatgttattttcttctttgtgtcgtcttcatcttgaaatatcgatatcaaatatactaacagaaactaaaacactgataatgaaacattatcattggtcattattacttgcagggctaacttgagaactcaaaagagacttgccgcttctgttgccggtgttggtaagagaaagatctggatggatccttctgaaaccgccgaaatcgctcaagccaactccagaaatgccatcagaaagttggtcaagaacggtaccatcgttaagaagccaactagaatccactctagatccagaactagagctatggctgaatccaagagaaacggtcgtcacactggttacggtaagagaaagggtaccaaggaagctagattgccatcccaagttgtctggatcagaagattacgtgtcttgagaagattgttggccaagtacagagacgctggtaagatcgacagacacttgtaccactctttgtacaagtctgctaagggtaacaccttcaagcacaagagagctttggttgaacacatcatccaagctaaggctgatgctcaacgtgaaaaggctttgaaggaagaagctgaagctagaagatctaagaacagagctgctagagaaagaagagctcaaagagttgctgaaaagagagaagctttgttgaaggaagacgcttaaacctatccaccaggttgttaatttttctgaaaagtaaatatctcatttatcaatatctctttgtgtcttaagttgttaattcgcacatcgtgcacataagcacacccatgactatcactttatttagtactcttttttaccaatattattacatctagttttagttttccaaaccgattaatattaatttgggtcttaattgaaagatgaaagagggagtcaagcaacatatgtgattgattgatttgtatggttcttcatgatgctgttgtactgaattgcaacatataaactcaactatctttatatcttcatgtactttaatatttcactgaactaaattgaaataattcataattaaccggtatattttcttgcttacttgaattatttacacgattcatactgttcgtttaaataagccactccatccagcggagtgggttttaattatgtagtttccttgctttgtgttataacccagctatcgaatatacgcctgtctgttgatattttatcaccgcatcgtgatacaatggcaaataatgaggtgaagtgatatcaaagtgacttttcgctattggaggaaacaaaacatgtcttacatttgtgtatgcataacttgcgtaatctgtgtctttatacttgttatcacgaacgattatatccttctccgaaacatcaacccattctgtttgtactgaattcataactgtgaatctctagaaatttaggttgggcgtcgcaccagtaaatatcatagcccagctaaatataaatcctgtgtgttgagcttgagataggagatgaagagcttttcttcttctatcctgaggcattcttgaatcatcatcgacttttcataagtcaataagattttcagataagagatattgcagtaaatcttgacaaaatgttattgacgacacattttgaatataatgaaagaattaagatactgaatagcaacgtttgctattattggcagtttgaataggaaatgtatctaatatagttttctttttctatctaagtattgtactaaatctaaaaacatgttacacacacggatttatagtttgaagtctttttgtccctggttggagaaattcctgtcagcatttttggtctcctcccgccagagttgtagagtagtcagtcgcttggttattcagaataaaccttcaatttcaccatcttcatcaatttcaacgttcatatatccagcgtgtgttgaaaggccaggaatagtttggatttcagctgctagagcatatagataaccggctccgatggatgctctcacgtctctaattgggaaggtgaacccggttggaacattcttcaacttggcatcatgagacaaggaatattgggtcttggcaatacagataggtaggtctccgaatccttgttgacggtacatgtcaattttcttctgagcttcttcagaaatttcgatgttagcaccaccatacatcttttgtacgatggtggaaagtttgttttcgactgtatcgttgacatcatataagaacttgaattcggaaggttgcttggaggcctcgatgacagcttctgccaatttaatggcacctttaccaccttctgcccagtgatttgttgaaacgacatcaaaggcaccaactctttgagcagcttcctttatagcatcgatttctgcttcagtatctgattcgaacttattgatagcaaccacaacagggacaccgaattgtttaatgttttcaatttgtttgcacatgttagcagtaccatttctcactaagtccacattctcctttagatattcttcaggcagagattgaccaggtttaacatctggggcaccaccatgcaatttcaatgctctgactgtggcaacaagcacaactgcatttggagttagaccagaagctctgcacttgatgttgaaaaatctttctcctcccatagtgaagtcgaaaccagcttcagtgacaacatatccagattctgcactctcgtcagcttcttttggcttacctacaagtttcaaagcaactctgtcagcaataactgatgaagcgccaatagagatgtttgcaaatggaccagcatgaaccaaaactggtgtcccttcaagcgtttgcatcaggttaggctttacggcatcctttagaagtgcagcaatggcacctgcacatccaatgtcgttaacagttataggttctttttcgtagttagagccaattacgatacgtccgacacgctctctcaaatctttcaagtccttagacaacgctaaaattgccatcaactctgatgcgacagtgatgtcaaatcctgtttgccttgtgaaacccttttcagttggcgcttgaccaattgtgatttgacgtaacattctatcgttgacgtcaaccaccctcttgatagtaatagtgtctgggtcaatgtttagacgtgcgaatttgataatttcctcggtatttaaatcatcaggattagttttgttaattcctaatttgttcaaccttgtcaacatagatggtgtaaatgatctgacacccttcttaacagggaccaatctcttgtaaaacgtttcgtgcttcttttgagtagcctcatggaacatccttgtatctatggctgctgctagtaagttattagcagcaccgattgcatgaatatcaccagttaaatgcatgttgaactcatccattgggataacctgagcatacccaccacctgcagcaccacctttcacaccgaaagtaggacccattgatggctgtctgacgttggcgatggaaggtttgtgtaaatgagcacttaaagcttgtaccaaacctattgtggttgtcgatttaccttcacccaaaggagttggagtaataccggcaacaagaacgtacttaccgttctcgttatctgccaatctattcgcaattttgggagaaactttcgccttataatgaccatatagttctagttcacttggatgtacaccaagttcattggcaactgcttcaatgtatttcggcttttgctttcttgagatttcaatgtcagatggcacttttgcttcaatcttgagaggcaatggtttaatatgtggcattctagtggattcctctctttgcctcttggcagccaaaagaacgttttgaaccaacatcgcaactgtcattggaccaactccacctggtacaggtgtaatgtaagaagccttgtctttacacaactcaaagtcgacgtcaccgaccaacttcctaccggattttttggatgcgtctgggacatagttaataccgacatcaatgacgatagcatcttgctttaaccagtttggtttgaccatgtttggcacaccacaagcagctatgactacatcggcattttttacaacatcggcaatgttctcagtgtatctatggcaaattgtgactgttgcatttaaatcctttaacaatgatgcaacgggagttcccacaatgtcagatcttccaataacaacagcgcgcttccctctcaaatcaataccagattctttcaacaatcggatacaaccgttaggggtacatggaatgaagtatggcttaccacctctctttgataattcaccaacattgaaacgatggaatccgtcgacatccttttggtacgaaacagcgtttgtcacttcagcctcatttaaatgacgaggcaaaggtaattggatcaataacccatgaatagaatcatcgtcattaacctgctggatcttctgtaacaatgcaagctcatcgatgtcctctggcagcttttcaacaatacatttcacaccagattcttcagatgcctttaacttcatacgcacgtatgcggtagagtcaggacgtgtaccaacttggataatttttaaacatggttcaaaacttggagacttgatttgaatctgtttgatctctttgaacgcttcctctcttatggatttcgcgattttggttcctgatagtaaatgataatgacaagttggaatacgcactggattgtacttgctacaggtttttaaaacccgtagagaactgtgcctcaaactattcctgactgaaacacttagcattactgctgtttgacaccgccaagtatcgatagtgctgaatccactgtttttagcttcagatctactactgtaacatgagtctttccatgcgatgagatggttcgaattcctggctcaatttccacttcgatttcgtcaatttttttttttttcaagctcgagacagatcgaaagaaatgtaaatctgacgtgtgacagaacagcatgagcaatgggatcagggtgcttgagggtgcttgaaggtggtgcttcattttattagttaggtttaatagatatatatataggagtatatatcactaaagtattagaaagatcaaataactggagaaaatttgtgggtatgtgtggtgatagataaggtaaaatgtcggctcattacttcattacgatctggcgggattgatattactgattacaggagatggagttgcgtttagttgtgaagctggtggtaaaattgggtgtcttcttggcagatccttgggttgatactggtggctttggtttggggattgattgatactaaaatgaggtaagtgatgtgattgctgaagattctgtctctggtacctctcatcgatcagcttcttctgttgattttctacctcttttgccacttggtatagagattggattgaaggtgatgagactgaaagcggcggttgggtttgtatgattggaatttgggaagcggaggtgaccgcagtgttcatggttgcagttcctgcagcagtaccattgctgtacacctgtggtacacctggtcgagtctgtggttgatgagaatttactcccgaagatagtggcgtttgaatggcaccttgttgaagttgtgatgtgtactggtaaggtttgtaaggttcataaggatttacaggaacacatttgaatgacttcagactaccatacaattcctgtgcaaactcaattggtgtagcaggctctttcttcattgggatatggtatggtaatataggaacgctagcaccctgtggcacgaaaactgtgtgtggtattggcatggtagaatatgcttgttgctgatggtagtgttgttgctgttgttgctgttgttgctggagattttgttgcggtagcatgtacccattttggcccatatatccgagctgagttggcatcatattttgatgatgtctggaatattcaatgctgttttgttcctgttccagaatttcattgaaagtgttttcaaacaattcccagttctctgcagtttgctcagcaccgttttcgatgagatgtagtagttgtgtctcaaactttgtggtctggatatcattgtgaatcttgttcgcaatagatttcttccaaacttgaatatgagaagagatttgttttttggatctttcctcaccggttttattcttgatgtatatcgagattagttcgtttctaccgtaattgttatcctttaattttatcttggcagtaccattcttcataactaattgcagtgcgttgataaacgctgtctccacattaggagcccatttgtcattgttgtttaagttctccggaacacttatggtgctagaattgaaagacatcgcagacattggggttggtaaatcttgcgatgattgagaatggcgagtatgtaacaagtgttgttgttgtggttgttgtggttgtgctggcccactcgatggagctgagggcatagtagaaccatttgcgttgatgctaatatcggataaatgatgtggattggaaactaatggactaatctgtttctctgagattcgctgttctaatgcaagagataaactctgcgctctgttggctgtcaaagactgtggtgtctttttatgaaccatactgttggtcgcagggagagacactttccttccttgaccagtattgattagaaggtgggatctatcggaataggactccgtttccgttggtggaggtttgtaatccaatatatcaggcaaatgtttctgcttctgagacccatcgttaatgtaaacgtcaaatactcttgtatttaaagatttccaggatggtggatctacgtttgtggaacctgttgcaggcgccgagtcttcgccagaatgttgggtagcgcctccgactgatgaatgggacgagggcgatgccgatacgacaggtgacgaacggtcaggctgtttctgatttgaattatcactactgatgttgttttcctgagaaccttccacatgagagtcgatactgttcaagagacccgcccttttaattgcagtatccgacatcttgcagaattgacgattcctgtctgtctgtctcgcttttttttcttgtcgaaaggtgaatattgaacacagcggaatagaaatagccccactatgcactcaaagaaaatactcttctctaaagtctttaagttaaagaggaaccttaatataacaggaggaaaggtatcgattgattgctatttaaacactcaaacgccgataacaatttttaagcctcttaatcggtaagcttaagtataggtaagcaaaaaaagaaaatagtcacacaaccttaaaatgacctactaaaagatttcaaataatcgtcgaatgacagaagcaattcaactaaagggtgtgatgtaatctaaaacctatgtggaccttttgattacacagttcttattttccctgtttctatttttttctatcctcttgatagatctcaaagccctagaatgtcgagaatctttactggaacggggaatggctgacaagtttatggtattgtttccgtcacctatccagaattaaacctcgaggtaggtgaaaatataagttgcttttatattctgttactcctgtccccaccttgttcctgagttatctttagattataccggtccaatgcgacacaatagatcgaagggaaacggttatgccgagtaataaatgcacactttgcaggcaatacggataatattaacgatggcaagcaaacaaacaaacaaacaatacaatataatacaatgtagttgcacggtaacgctgacgtattatgtaccttccctcagatcttgcggcaagcaatatcaataaatagtgaaagaatgaaaaaaaaaatctagcagctggcaagaatgacaagcacgaaaagaggacgaaacgagagtatgttgttctggacctaactttgctgtatctctctagcgtagtttcaattcgtttttactttcttttctttccctcacgaaatgcttataggatatttggtaatcaccttagcttatcctttgcctctccgttttcgaacgaaaagcagcagcagatagaaccagaaacggaggggtcgagacgaggatgtgggtgtgacgagcaaagatcaaaaggatctgaaactagctctctgccttaaaaatactcgcgggaagaccgttttcgagacttgatgtgtctggaatttttcaccgaaatttgccataaaatatgaaacacatgcaacaaaagcgcacaagaatccagagttatgtgaatgaatttatacgtcacagattccggaacgacgctcgatgagaggggtcgaatctgtctatgtacgtattattgcagcgtgtgtatgtgtggatagcccaggaagaatgggagtataacaatagtactactctttcaatgcacaagcgataaaaagattagttaatcaaagctccccatccaaacctttcgcgcaccttctcagacacctttaagataagaaagtgaaagtattgcagcggaagacttcgacgaattcaaacttagtgaccatgtagatattgctaattactataattattttcttactggcaaccgtcatgtaaatttccggagagaatgtagcggatccagaaaaaatctctttggatgtcaacaaaaggctgggatggatagcaaccgaccatttgtcatttgtcataatccttcggatctgaagagctctcgaacgacagatgggtgaaaagaagcggaagccgcaacgttgcttagacggaaaacgaggcacgtgagattatgtaagagttgctgcaaagacctagactcatcctttttcatccgctatgttttctgttctcttatcaagacagagtaatgaatgtccacacgcgttacatttgcgccggtgaatgcgctgtgtgcggcatactagcatcttgcccattcatagagaatgtgagctgaagtgttgcatgctagaacaactttcacttctgggaattacgattacatacattaacacttttttttttctcattcacttccgtcatccgctgaatgatgattataataatctgctttcgacacacccttcataaacacaccaagagtgttgaactggtgcggacttcccgtttggaactattattagatattcgttccgtctattgcctaaaagggaattacaaaaacaaacggcgtccgtccacaaaaaagcggcttctcattcgagacacaggaaaaacgggctagattatttccggtttaggaaacggatttttttgatgcgttttttgacatagggcaggctagagtggacgagatcttggtttgatcgggtttaatgtacaaaagctgtggtgttgtatgggctatggaattatttaattcaactggtcttggtttttacatgcaatgcaacagtacttcttcactctttattcttcatctgagttcaagtattgggcgtagtcttctgccgacgcaaaagttggtagttcgcgtagtttttgtttctttgatttctttcttggaggttgttgctctgtgtcttccacatcagattcttgcgaggagtcgtctgcagcactgtagaatacatcttcatcagattttacttcgtcttcgaggttatcttcaaacaatttggcctcttctggatcgaagtcactgatgtcttctggttcaccttcttcagcttcaagatcagcttctgatgcctcatcttcgtctcccgaagatgcaaggtctttgagatcaatatcgacatcttcggatgacgatccgaaatcatcctgtgagaaatcgtcctcactgaactcaacatcgctgtcctcttcgtcaccttcgacgtcaggtcttgacttcactaaagcatcccaaatttcatcttcgtccaaatcgctttcctcgtcgaattcagctgtaccgttttcatcctctgcacctgacttggtagatttgatggcattagtctttgtagagaaatattgatagaagaacttttcatctggcttgatatcttgcaccttcttacttaaccagttctccgtgttagcaggtacttcgtgcaatgtggtatcgctggccttcactaataacgaaccagtgtgtacacctcccaaaggttgcatgatagatgaacctctagtggttggcttttgcttggcgttacggtacacgaatctatccaagaaatgggctaacgtgaataggccaagatcgggtttgactaactctcttgtttcttgagtgtcaccgtcgaagaacccttgtgcgtacgactgcacagtaggatggaaatgggacaagaattgatttatctcccaaagcgatgaattttcagcgttggcatattttggatcacgtttacggctatcgtaaccaggtttttccttagttttatccctggaatcttcgtcatcagattcgtaaacagagtctagtggtgagttgattagaacatttctgatctgcggtaaactctttgaaagttgtatcaacaaaaagaacataccactaatggcaccgatgttcaaccaatgggcacagacttgcaatatacgttttacgaaagcatccactcttccaatgtctttatcatctttcaaagatttgtaaagcaagtttaagtaaataccttgcttcgatgacgacaccaatcttgggtcgagtagggattcgtataatgtcttgtaatatctatcacttgtgatgtttgtcttcacgacaacctggtgaatcaatactaatgcttgaattgaagtgttgaaattagacgcatgtgttatcttgaacaatgtatcaagatgtatctcgtacacggatcccggcatatcagagaatgggaaagcacgattcaaaccagttagaatagcaccgaataatttggtatttttttcctcgataacttcttgagcacttttttcttcaatgacagacttaccaccctttttacccttcttgaagttcttctttctcttcttttcatatgacttatcggattccttgatttcactctttgattcctcgttatcagcatcagtttggattaagaatttctcgaataaagtgaaataggtcttgattagctgatttgctagattcttctcggagcgtttcaaaattgtttgattaagtgtcaatgcggaatagtatgtagtatgatagtcagcttgaggccttatggcaatatcgacaacagcgtctaccacaattgatttcatatttggatgttgagtttcaagtttcaaaagtttgaaggaagcctttgacgctactttgttatcaatgtcacctaatttgttaacaccaagtttcaacaagttgaattcctgttctggtttggctgttagcaggtcaaagatatgtgttagcacttgcattctgacatagatgataggatcatgggataatttctcaaagatttccaaaatcttgaaatatagacccttcaagtaatcctcaaaatataaaatagctaaagttctcttattcagtagcatggaaaggttttggttcttgaagtattttaacttgcggtcaggtaacagaccatttaagaacaaatccttcagagcattcaaagcttgtaatgcggaatttcttgacttcttcccgcaaaaggatatcaaagaatcaagagatttgatattatgcaatggagattcctgtagcaataaagtcaaagcactaattttatcgttcaacgtaccatcgcttaagatctgggacataaacttacgttgagatgagttcttggtaaattcttcgtagtaattagtgttatctaattctaaggcctctttaccacgctggtataacttatctatctgttctttcgttagcggatcctgttctcttgttaattcagggtccaaaggaacttcgtaccacaacaaatctgatggaacaagtaatttatcactttgaacaatatgagtttgagtgatcatgtcggattgatcttccttttttttttctgctggtttaggactaagtggttcctcctctttctctaccgtctcttcttcttcttcttcttcaacttctacctcctcctcttcaatatctttctcttctttgcctgcatcctcagtaactgttggttcttctacaacttcaggttcaggtagtttatcgaatcccatattcttcaataaagcactgaaatcgctcttaaactcgtcatcaacttcttcatcggcttcattgaattcaatctcactggcatcgtcgtcaacaccatcaacaagctggacatctttttcagaggctccaagagacagagcttcacggatcaattcttcattggtgacagcagtttcctctttagctggagtaacgtctgtctctttttcgccctgcttcttactcttcttaggcttagtgtctttggcctttgaagctcccaatttggaggacactttctccttcaatttggataaatcaagactcattccagatttgcacttgttatcgagtgttgcttctttccaagcaatagatcaatcaaacgacaaacagagaagtggcctctgtgtatatcaacaaacacagtctgagcgcataataagagttgagatgagatgagatgagatgagatgagatgagcttgattttggtgtaaaggtagaaaatttttgtcgtttcttttcatcacgtgattaacgattatccgggtaatgagtttgtctctctcgtttagtatttacaaaagcattctatgtagtagtgagaccaagaagcggggaatctgcttgtcacatggtttgccgagagcgttacgagccaatggacatgctcaggagtaggtaaagcgtgaaagtaagttgaatcaaaagttgcacaatgtatgtacttccctcaagtatccgcctctctgcattggaatttctttactggaatcaatcccaattaaagaatgttttttgggacctcgccattacccgcacaaacgacgtgcatggtggaagccaatggtgccattagttgccaatggtgcatgcatcaataagcattgacacacatacatatacattcttggggcagaaatagacgtgcatttgcatgaattgattggaaactcatggtttcagatgcaccagctcgaggtgaacaaggtaagttacgtattgagaacaactcttggtaaaggaatacttctactatacttcttcttcttttcattgtgcatacaagagaagaggttcaagtcgagttgattacctcgaaatacaaggtgtagttttagagggacattagggtcatagatacgaacccattgacctgcctaaaaataactcaaacttgtacatttcaaaagttgaataagacaaacgagattttctttctaagtagcgatagcgaagaatatctatatattcgtaagacaatgacaattggtatcctaatgaatggacaaaggaaacgtataaaaaaataactgcaatggcatttgtctttgtgttttttctgattttcatcatcatttcactgaaatgaaaataaaaatagagtgctaatggtaataatggcgtgataaaagtaataagatgataaagctgatccttatgatatgggaacaatgatggcaattgacggggaagataaagcttcttaagctgtccgttcaagctaattctggattttccatcgaatgctgtagcgatgctatgatgttttgtgacgtttctttgcctttttctattacagagtcataaatccaatataggtagatgacgacaaacacacaccggggaaaggagtgaaaggatggatggtgtgtgaacgagagaccgagcatacgatgccatgaaaaattgaagagttacttcgaatctcatgctgcttttttctatcattagaacaaaaaaaaattagtagtaaaaattataacaataatagtactattaatcccattcaacattattatcaattagtggtggataatagtagtataagcttcaggttgggaccattaacgaacaataaaaaaaaagtttacgttccgatagataaacttaagattttattcatccaggttttggtggggtggttgttgatagtaactttgatatttcatgaattgataattctgttgtgaaggatggttatgcattggtgcgggaggaattgcgtacattgaatgctgttgagatggaccttgcccatgactctgaattaatccctggccttgtgatgggtgtgctccttgaacctgccccggttggcggtagaaaggacccgacgaaattgaaggcttagtggatgaaggaggagtcaccgaatgactttgtgagccttgtaaattcccctggtactggggttggatattactttgttgtggttgctgctgctgttgctgccgttgctgttgctgccgttgctgttgctgtttctgttgcgactgttgttgcggctgctgatgctgtttagggaccattatggaattgtggttcatgtttggagatccaggactgttgtgatggcccggcatgaactgagccaactgcatccgcaactgttcattttcctgttgcagcagactgttcttgcgttccaaatgtttgatgtactcatgagattttgacaaaatttgaaccttgttgactttcgaaggtggagccaacccttctagcgattccacaggaatagagttatcgtcacaccatcgaagtgtcggtaccgagtttctcaaaaactggaaatgagtgttaatgttgttccgatactttttctcactatcgttatgacccgaggaggtgttccccgaatggttcacagcagcaccaccaccaccagaaaccgtgggagccaatggagtcattaacgcaccgtggttcgtaaatcctgggatcgcagggagcacgggaagcccagtcactgcagcgttaaacacagcgttcgggttgtttccaacgccagtattggcgttgggccctgaggcttttgtcaccttatatgtattctgcggcagattggaaaagggaacaccagcagcggtgttgttgttctggttgctgtaggtatttggatgctgctgctgctgctgctgctgctgctgaacagaagccaattgatcgctgttcatcaatgcattagaagaggacaccaaaggactcaattggcttcctggtcctggaacagatcctgatacatgtccgggtacttgatcgtccgtccttttatcgtttgcgtatgcataatcagacaaaggcatggcgcaaaaaaaaaacaaaaagaaacaaaaataagaaaatgcgactcgtgcagattagtgcaggacacgcgtagaaaaaaaaacgtaaaatgaataaaacagatcgatgctaattctcactcagaaaatgagaaaatttcgcagaaaaaagtccaaaatagagagaagtccaagtaaaacctaagatgatcgtttatccggccgttttgctcgtgcgttattcaaaataggtctggtctggccaaatcagatcagatcaatatttcctaaaaattgtgcctgtacttgtgtcgttttagcttttccgttgcaatgcaaaggctgattctaatataaatcttgtcagtacaccctgtaaaaagacagagagctgggatttttccgaataaagcaaaaaaatgtgaaaaaaaaggaaggaaaggctctaattaaaagcaacagaagagcaaaagaaagatgcagaattttttgtttgtttagtgcagtaatgaggacttgcccgtctgatattttcagattttccttcaccaagattttccttctgaatcggatcttgttgcacggtaaaatcaaacaccaaaaaaaaaaaaaatagcaggtaaaaacagatgtaaggtttgatttccaaatagcagttcagatacctttttcctttttttgcggaggtaggttgctatatcttttgcctattttctgtcaaataaggaaaaacctaaaccgaagaaataaaatcaaaaaaaaaagatagtaaagtaagaaaagggtttttgtttttcggtgtgagcagtttgaaaagcgtaaactctatgggtgtggctaatattttgtttaacttttatcaactagtaaaactctgtcttgtgagtgtttcgccagtagtaatcgtcagctaggttatatcttgtatccgtgacttttgatttgaacctttttttttgctatcaatagaagctaagaaagacagaaaatgtccgaaagcgtagtaggacaaaaaaaaaagtgtacaaaatctaaaaaaagcttcttttccttagaaacaagagctgagaaggtaccaataagacacgcttgaccaagaaaataactttgagtgtcgaactaaaaatcagttttgattttatatggctggtcgagtggacaatgaaacgtaatttccaatgcactttttattcggttttttctttattatctgatgtaatgtttattcgtaaaagttaagaatgaatgaatggatgctaatgcgcgtttgaaaaaaaaaaaggcactggttgcaattgggtttctatgtgggttacgttcttcgcctttttgtatgaataatgggctgatccaaattacgcaaattgacgtgttatgtttgtttgcacgagtttgctttttttcttattttgctcgttttgtttctcacacgtcgttgtacgtagatttctgagatgttccagtggtttctctcgaacaaaaaaaaagctacccaaaaaagctggaaaggagaatctctctcagttctctttgtagggaaattttctgatcaacgatagagatgttcacaccgacagatccccgcagaaagggaggtggagtatgcagacaaacaaagcacaaaaaaaagatctggaaggaattttattttcgattttcctagtgcggttgtatttcttatcggtgcgtcatgcacgttttcttctgtgcaagaacccttgttacacgaagggaggctagttccgctctacctcgcagtaaacaaaaaacgtcaatccagttcaaatcgaacacagttagccaagccaagaagccaaaccaagactgagaaaaagtgtggttcacaaagaaagggatgtgattcggtagggtttacgtcacccgcaaaagatggcttagtctgttttttttttttttttgtttttcacgcagaccaactttcctcaaaacctatctctaagcctgaaacggagcagaaaaagttgtatttctaattgactagctagcggtagaacactgaatgtttgcgttgtgctccttccttttgcttgaattgacaggacaaaagggaagacaagaagaggtacgctttgacactgtgagggttctctcagataaatgattgacttcaaataagcgcgcaattttggtcattcaccagcgatacaagaaaccaagctcaaaaatgacctgcgtctttgttacacttcatcttttttatatgtgaggtaatattacgggaatcaccgatcattgtgatcgtaatctgctgcagacgcacgcacgggcaaatcgttacatactgatgaaccaatgtgatgtcagcattcagtgaaatttttcttgaaaattttgaatttcccttctgaactccgggctttaagtgcagcaaagagcgaatgcgaatgccgacaggttgcttgatagtggcgtcatatatggctaagtcactgttctctgcggatgatttgattaacgtctgactgactttcaagtaagaatgatggcggtgcaccccttctgacatgccgtatgtgcttgggaagcttgagaaagctgagcgaaggagcaaggcactggtctgttccttgtttttgggagatgtgttaaatagcggtttatgattatatatacggtccacgtgactcactcgagcggtgttttttttacgcagggatttccgcaggaatttccatttggcattctgaactggtcttgcatgaaacttgtaagacagaatgaggaagtaattagttgcataacaagagttgtgcttggtcttctcttatcttgccatttcctaaacggttttgcccgaatgtacagtcttttttcttatccatgagactcgtcatgagagtgggatcttcaagttggaacctgcaatagtcttgtattatctgtcatgatgactcaagcctggcgattaccaggcaaccgcggtgtgccttctcaggttaccagcgtcacgtcataaactggtgctaatctccgaacatgtataacccggactttatatactttctccgggtaactttatctaaaattaaaaacccttcattgtaactgggattaccctcccttctcggaacaattttttttttttttctttcttattccttcccaccttttcgttttccacatccttttcccaatcaaagttgtttgaaagttttgaaaattaccattcagtaacaattataattaatactcacaattgccactgttttttttttggttttggttttgcttgaactgggaaccataggtctttcaagatcggtatcttttccacaactataacttcggaagtgtttaaaaaggttctgggtactggttacacatttgttcactcacacaaaagtttaagaaaccgaaacagcataatacccataataataacaatatcaaaatgtcttctttaaagcgtattactaaagaacttaatgatttgggaaggtatgatactagactacttttttttattttacttctactaggagtgtcaaggttttgttctatgttttgatatggtgaggacttaccctttgtaagaaggttgttccctaatttttttttttgccacggtttaaaagaaggaccggctctgttttgatccctcatccatcgaactatggaaatgacagctttttgacctctgttaatcccactttttctcttttactaacattctattggaaaaaatcgcatttccctcttttttccctccagagaccccccaacttcatgctctgctggtccagtaggtgatgatgtatatcactggcaagcctctatcatgggtcctccagattccccatatgcaggcggtgttttcttcctatcaatccatttcccaacagattaccccttcaaaccaccaaagatctctttcaccactaagatctaccacccaaatatcaacgctaatggtaacatctgtctagatatcctaaaagatcaatggtctccagctttaactatctctaaggtcttgttgtccatttgttctcttctaacagacgctaaccctgatgatcctttggtccctgaaatcgctcatttgtataagaccgatagagctaagtacgaggctactgctagagaatggactaagaagtatgctatttgaaagaaatataacaaaaaaaaaagaagaatgaaccgaagaaaagaatactacaaaaggacagggttcggcggaaagtaatatcatcttaatccgactaaaaaaatactcaaaccttccaccattgtatatcctacccctttttgttatcggtactttcaactcacatcgttttggacttcttctgacacaattctcaacttcaagctttcaaggtttaaagtattagaaagaatagtatatatattaacgcaccaattttctttatattatattgtgtatgtgctcatggtacatgtaggtatatataccgtataattttgatatatttcatttccattagacgactgtttccgacaggtaagctagaaccattggttataattatacaagatttttcaagacttttcaagactggtttttgtccacagacattggtttctgaatgtgccaatttggtcacaattatagaaatggagagacatacgcctgatcattctagctagtgaaaatcaatttatcaatgcttacctaggtactaaaaacctaccacaactagtcctatatatatagatacaactgggtagagctgttggatactcaactcttgtatgttaaggctaagcgccgctgaaacgaataagccgtatgactgtcccaatatcactttatacgttttgatgttttttgacatttcgtgaattttggaaaacacagacaatcggtgcaactgatggacaaacaagattcggaccatacactcaaaagtcgtgccgtttacagcttgtatcagtaaaacgagaggcaagcgagctggtagtgaaggaattgattcagaattttccttcaaaactactctttatttactctagtggttctttctgcggaaaaagttgactgtccatgattacaagttaccagcggtccgatgccgccgcaatacttcgaaccatccagaagttattcgcagatgatgtatttaaaaagcacctcaatccgagtcagttacttttattgaagtacttgttgagtctaccagaccaagaatcaaagacacttatatgggatgcgtttctctccggcaagttggaactatttgtagaactgaatacaactcttaatgcaacttccgacaaaggtgccactaatgatttggtagcggctaccagattaccatcattatcaacacaacaacaacctcaagctagttctggactctcgagaactggcactcctttacatgattcgactgataaccaaagtgttgacgatgacgacagtgatatgatcgatttggaacaattgaaggcccagctagatggactggattttataggaaatttatctatgaaagtcaggtacgttgtatgggaacatggactcactctccttgagccagaaacatcctcagaataccttctacttgacacggataatgatagcgctgtaatagaggatggaagtaataatactcttatagatcaaagtgcggttcccaactcttccacgcttcctacaaatgacacagcacccttgactatgaaagaagtgagcaagaatagcgaaaacaaagaaggctctgatgaagatgataactatgatgaagatgatgatgacgacgacgaggataattacgatgatgctgaagaagatcctcaaaagatagaaaaaaatgatacagaaaatggaaaaatctctcatcctaatgatcttgatgagaaacccaaagtgtcagatgaaactgaatcgccaatttacgagcaacttgataacggactcataagactgcatttcatcatctcaaaggaaactttgaacgaacttccatctgtaaatacctacgatatcatcggtaactttcacaaaatatatcatctctttgacaatgataaagagaccactatgaggcgtttaaaacttcaggaaaatgatcaaatgctagaaagctcaaggaaaaggtctcacgaacagattgaagacgaagaagaggatgactcagggaaccctagcatatctcatcataagtctgcggcagataagaagatcaatactaagactaaagcagatatccaaatggacctcggtgtcgtaaatctgtcattaaggcatttgctcaaatcggtacaggaaaataaaagtaagctagatatttcagattacgaacttaaacatttattaatggatgttagaatgaacagatctaaatgggcttctgaagataaaattggacaagaagaattatacgatgcatgcgagaaggtggtactggaactcagaaatttcacagagcattctactgcatttcttaacaaagtcagcaagagagaagctccaaactattaccaaataattaaaaaaccaatggatttgaacactgtgctgaagaagctcaaaacttttcagtataaatctaaacatgagtttgttgatgatattatgttaatatggagaaactgcctcacgtataactcggatcctaagcatttcttgagagcccatgcaattgcgatgcagaagaaatctcaacaactagtaccactaataccagatataacaatccgtgatagagcgcaagttgaaaaagaactagaagatatagacgccgagagcaacattaaagacgatgaagaggatgctggttcaggtcgtaagggtattcagagacgtggtgttcaaaaggttattgacgatgaagaagaagaaatggaagagaaccatcctggaggtaaaaaaacacgagcaactgatgctgaacggaatcaacaacaatccaccaataaaacagtaagcagtgacaaaacaccttccactaacgaagctgaacaaacgccagaagttggcatagtttctgcagaggggagaggctccaaagtggctcaatcttcgactaataacgaatctactgaaccagcagttgaaagtaaagcagtgtcaactgttgaaaaaaaccaagaacatgaggatgcagaagaagaggaagaggaagaggatgaagatgaagaagataatgccgctggaatgatgcttcttgaacgagatgacgataaggacgatctggaattgtccacatggaaaacacttacagccaaagcccgtgctgaaatttgtttgaaaagatcacaattgttcaacgaacacaaaattaattccgaatctgatgccctcttgaaaaatccttctaaattaaagaattttgatcagttcttcgaggagtataagcaacagaaagaagcagaatttgcaagacaaaaattacaagaacagtcaatgatgaaaaacggttttggggcaataatgaaccaagcagatagcagtgtatcgaatttttctgacacgaacgttaaatcacaagatgccgaaagttccttgactaaagaatcgaatgaaatcactctcgaagattcttcgttattgacagagtacaacatcactaattatatcccggacttggcatatacaggtattgggaaagaacaattagataaagctgaggaagctatggttcaaaaaattatgaaggaaggaaaagtaatgaagagctctttgttgaatactgtcgataaggggttgagtccaaaaatgaacacgaatatccagttgatacatgagattaggcatatatgtcataaaatttctttgattagagcactacaaaatccaaataaacccaaaaattcacaacaaccgctaaggttcaaagaattcataattgatgactccttagacctggatccaatttcccagctcaattcacatgactataaaaatgatgagaaattgatcaatcgcgtattacatcgtaatgtttctaagataaccatgtcaaatggttttgagagtacagaacctctcgcgttaagcatgcttacagagatcacaacagattatttatctaatctcatcaaaaccatcaaacttcaccatgaaacgcattcttcgaataaaagaaaaccagcggaagctctaaccatggcattgttagaaaatggtataaataaaccagatgatttgtattcttatatggaaaatgagttcggaaaaaagactagaaaactcgaagatttgaaggttaaattaagctctttcttaaaggatttgttacggccgactttacaagatataagtgaaagaaactttgaggatgaatcgcagagtttccttacaggtgacttttcatcagaggtcactggtgaagatttctttggtttcagagaattaggacttgacaaagagtttggtgagttggctaataatgtcccacttcaattgctcactttccaattcaacggaaaagatactgatatccaagtcaaggctaaagttatccaaccagaagaatttgaggatgtcatatacaaaaaactcaacaaagaaaatgtacaatctgactcgtactctaaacttatacagccactattgcagagtgccgttgatcgctgttcagcttactataccaagcttgcaaggagtaagaatgcagaccaagtgcctaagaattacgagagtccattatttcctttacttgaagacgaagaattccctaaagtgaaaggtgctaatagaccgagacttcctccaacgggtaaaattagtacaaactacaagaagaaacatgtctcagaattatatactttgcctgaagaggaagagccccaagtgaaagttgaagtctctgaagataccgcctcgaaacccaccgatggaatcttcaaatctccagcgacagtcgacgataatggattttacgttgaggaaactccactctcatcattcagtttaagtttaccagggattcctgatacgtaggaacacagaccagcgaatatcttgtagctcttagagttatatacagaaataatacaagagtattaaaaaacgtctataaaagttcctttttttagcataacgatcttaatattaatgtcaacatagtaaaagggtaccagtagccagtactgatttacttccctaatatacttggaagtacaaggccaaataacagtaatactcagttttgctcctctacaacctcttctagaatttccacctctatgtctgggtatccaatatcacggaaagcttccatcaacttatctttgagctcttgcgctgtcccgcctttataaggagattctatctcatcagtagcaaatatatccggaactagaccagtgcttttctcgggtaaagagttgcttgatgtctcatccgtttgattaactgtcattgagtcaaaatataccatgttatgaatcggcaattcatttaaaagggaggcatcattattcaccttcccaatcgcttccgaggctgaattcaattccaagtcaattaaaaatagcagatttcccgtttcatctactacaggcgctctccatagaaatagatcaccaggtttgatcgatttcccggtgggtgattgtataaagtccgaaccaatcaatttcttaagactagatatgaagtctccaataaacctttcttctactgtgagctcaaagagggtagtttgagaatccagtggttcagcagcgtgatacatcaattgacgcctatccttcgcactatttttaggttttaataggtatatgccatgatcaagtacagtagccgaatacctgttgaatatatcaagggcaggactcaatttgctgccgcttctatggcatattatgttgtgttcagataattgaccaagcaacggattgaatgagctaagttcacataactgtggtagaaacagtctcaattggtacttgcaggattgtatttctctaacttcaagatggaaaggcctcgatagtggacgtttagggcagatgtattgtatttctacctctcttggtttatgtgtaagatcacaagtgcaaccatctaccaaagtttcgctaagatacactctaccagttttactcttagcaaagtgataatcaatagttgagttgtagttagatgagttccctaaaaggtacgtttcgccaaaataacctttttgcacaacagtcctcgtctcaccagaggatataatataagtccagtaagaaataggcactgtattcatttcaatagggtttggagccaagatcgcattaaccatgttaactgcttcaatgagagctccttcagaattaaaagtatcttcttcatgatgttgaatcaacgacgaagtgttcctttggtaacacaaaacatcggacccttcgtaggggcggaaaagccgtccttcttggagcaatgtctcattatctattacacttaggaactcttgctcatcaacgtattttagcgaataaggcgtagagctatatggattgaatgctgagacacctgaataaatccatgagatagcaaacaccaccgacgtaactggtaaaaatatcatataaggcggcagatacactagctacaatcaacctctgacgaattgacaacaatgcgccaacaaataatagctccgtatatcatttttgtactttccactaagtaaacttaaacgtttgtaatataagaatccaattaatcgaattaatccaattttaaaccttaaactgaataaatgtaataataaaaaggatgaatctcacagcatagactggtgtttccatcatataacacagcggaaaactggttggatttatcttcaaataattagctatgctaaaaatgattcaattgttactaatacttctgtttcacttgcgtgcggtagtggcatctctacaaggtactggtgatctttacttattgaacaatttgaatgaaaggtacagcctggcaactttcgaagctggtgatgaggtaggtattaacctggctgtgacagccaatcgaattacagacggtgaatataaagtttgtgggacttttcaagattattacgatgagtgtttctctttcatccatataaagcaaccattgtcatacgaactggagctggtggtacttgatgataaactagttcgtatgtcgattcatgcagatgatagtattgatggcatcgtaccactgataaaggaggttggaaatggtcccataccggaaagtatcaagttgaagaaaagaactctgacttacgaggcaaagaaaaaagctcagagaaaggatacagggaccgctgcatttgaagaagatgttgtagagaacaaaacgtttcttcagaaaaactggaagtacgttgtcatagggctactcgcctatgtctttttatccagtggatcacagaaataatttcatgttttaccatcttgctacgtatatatacgttcaagaagacaaagaaatgaccagacgactgacttttattgcttggataggataggagtggttgaaacattcaattaactctacgaatacgaaatgtattacaattagtgacatggattattttgatgagcaatttgccttgagtttattaattgagtgctcgatggaaagactgaagtgaaagatttaccaatgttggctttttaaaaggatcgaaactaagcaactccattactcacttcttatcaacaatcgatcatgcttttctcatttgcactgtaacactgtagttgctgttacgataattcactttgcacttgactttccagtcaattagactgccaatcagcttcacgatatcatgcacagtagtgtttactaccaactcgatagaactgtatcccacttcacatcttatttaatttatttacctgtatatcgtcataaacaagtaatgaatgaatttaaaactgttgggcattcaatcgtaaacctcacatcaaacagtatagaaaaaaaagggaatccttaaaagccaaccatatccacatagctgttagttttcgcggcaatgcagtggcatatcagtgattacatcaatccggtgacggtacagaggtatcagactttggttacatctatcttgccaaaagcaaaagtatcaaacgatatatcgctttcaggttcacatttattgttcttccatccagtaacagctgccctcagcgaagacggatactactcgtaccagactcctggtgctatattgaaacgtgaagtgccctttcggcgtcgcatgtgggttcagggatcaattgagttcaagaaatcactgacagatggctggtacaattgtcaagaagaacttaaattcatcaaagaactgaacaaagaccatttcgtagggttgaagagaactatacgagacgaaaaggggtacctatatgttaaagagttaagaacgttgatatatactaatcaaaaagtctcagataaagtaataaccaagtccgaagattacagtacccgagaaatcatcaatttggaagatatcgatgtcatggtttacagttcgatcagttcgaatcctcatagaatacattgggatagggactattcgcgcaacgtagagggataccgtgatgttatagtacagggcccgtttttggttcaattggtgatcaactatttcgaacaatgttttggaagacaagtctccagcataaaatacaagaatacgtctcatgtgtatgctggcacagatcttgaaatctgtcacaatggactcgggaaggatggtcaaatcagtataatattgagagatcctaaggattcacataaggtttactttgagtgtaagatagcttcatgtatacatatagagtaaaagtacaatcattggtggttgaaatgagccttcttctttcctgggaaagatgcaagagcggattcagtactctgccaatgccgcagtttgtttgctggtttttgatcaacatctattatcgtagccttgacgctccttgtattgcgggaccaggtcaagaaacaggtcacatctcttagcgtcattagcgttgacaaatcatctttcacaaaacgctgagcagcatagagcctctgtgtaatactgtcacttgattggagatactgcagaatgtcatcaagaaattcttctggcacttggcgtcctgcaaacagcgtttcgataatcagctccggatcatgtaaaaaacagtactcaatatctcttcccttcagcgagttatgtgtacaattcctacaataatcactagattgatacaaccactttggcttgaattcccaagtaatagcatcattcaatgagcatcgatagatttgattgaaatggtccaactgttcacatgtactatccttggcatgcaataaaggcatgactatgcattgcatatgactatcatcgattaagatattctcatctttcaacacattaatccattttgtatcgacaaacacctcttctaacctcatggaaacaaccacatcggccaacataggaagtgacctgatcttggaatcgataaactggaagttgtcctgcacatatgcattgttcctggaaagtttctggtgccttaagctgatacggtacacttcaccagaaaggagatagcaaacattagcattgcctctaccaacgaacaatagagtcataccatagtttcacacaaagaaccaaggcaaacccaaaaagtaggtcatgtgtttaatcgtggtgcagcatcgtttctttgacttgtcatctcgtcaccagattagagatttataaaactaaaaggctttaccttttaggaatttttcacttctcaccgcatgaactttacaactgtaagaacaagacggtattaactctgatctataacctgattcaccacattatacttaggcgattggagcttcattgttcagaaagaagtgctctaccaacttacctactaacttacaacgaaaagatgtccaacattgacggtaaattacctgacatcttaagcgatgctgtgttgaagcaatctgttccagtgcctgataattttgttaaggtcgaaggtattgattacagcaaaccagaatcacgcaacatgcgttctaaggatttaattaaatcgatggctactatgggcttccaggcgtcttctttgggaaaagcctgcgatattatcgatgagatgagatcctggagaggtgaacatcgtgacaagttggaagaacatgaccgcaagggttcttttgacaatgatgggtaccaaaagactactatctttatgggttacacttcgaatttgatttcttctggcttgcgtgagactttacgtttcttggttcagaataagatggtcgatgccattgttgcaactgcaggcggtgttgaagaagatatcatcaagtgtttggctgacacttaccttggtgagttttctttacctggtaaagggttacgtgaccaaggtatgaaccgtattggtaatttgctggttcctaacgacaactattgtaagtttgaagaatggatcgttccaatcttggacaagatgcttgaagaacaagaaaactacgtcgaatctcagggtaaagactgtttggatagcaacttcgatcaagactctccggtatggactccttccaagttgatccgtaggttaggtaaagagatcaacgatgaatccagtgttctatactgggcttataagaacgatatcccaatcttttgtcctgctgtcaccgatggttccattggtgatatgttgtttttccataccttcaaggcatctcctaaacagttgagactagatattgtttctgatattcgtaagattaactctatgtctatggaagcatcacgggcaggtatgattatccttggtggtgggttaatcaaacatcacatcgcaaacgcatgtttgatgagaaacggtgcagattacgctgtttatatcaacacgggtcaagaatttgacggttctgatgctggtgcaagaccagatgaggctgtttcctggggtaagattaaagcagacgctaagtccgttaaggtctatgcagatgccactgtcgttttcccattagtcgtcgctgccacttttgctagcgaatagaacactttataaaaacaatagatatctgtatatattcataacctcgagtctgagccaactgcatgagaattcattgttgtcagtggtgttggattgggtcaacaccacttggttattaagacattcactcaacccaattgtaccacgtgatattctaaatttttcaagatcgattcaacctcgaaaccgtctcatctcgctctctctttatcttgagttaacgcaaaagaaccgacaaaacagccttccgatatggtcttctggtctgttttaacagggtctcaagaatcacctgtgatctgtttcactaatgtttgctgtcagacgcaatttcttgcgggggccattgagagtaacgcaatgtgggccaagcttaggttcgggatataaggttcttgatcttgtacgctgcaaaagtacatacataccttctccagattccgtttacaagaagcctaaatcaaaggagcagattgctagggagaagcatgaagcggatttgaaatctgacaactggattattaggtacggggccattgcaaggtccgagaagttttcgaaagctttaacgaaatacattcttgccgcatatgtggtgttcattctatatgggttaaactataccaagaagctttataagaaggacaaggagttagaagatattagtgcaaagattgatatgggagtagcaaatgaatatgagttgttgcgctataaggaactaaaaaatacgttaagaacaagagatgtggagaaattgaaacaataccaaaagattatagagaaagatgggactgagaatttggataagattaccttggaaaacaacgatcaaaacaagattaacgagaaaattctacctgctagggataccactgatttctatgaaatgaaggcagaagagtacgatgagggtgtgagttttgaagaaatgatgatcagaatgggtaaaagacgtaagtggctcatgaaacattgtaaaggagatgttctcgaagtcgcttgtggtactggtaggaatatcaaatatttagacccaacgaagatcaactcaatcacattcttggatgcatcggaaaagatgatggaaatcacaaataaaaaattcagagaagcactacccaatttcaagaaatgtgcatttgttgtagggaaagcggaagatttgatcgacttgaactcgaaggagacacctgttaagtatgatactattgttgaagcgtttggtctttgttcacatcacgatcctgtaaaatctttgaagaattttgctgaattgttgaaacctggcggtagaatcattctcttggaacacggaagaggttcatacgatacaatcaacaaaattcttgacgatagagctgagaaacgtttaaagacatggggttgtagatggaacttggatatcggagaaatccttgacgattctggattggatgtcgtcgaagaaagaagaacacatttcggtacgacatggtgtattgttgccaagcgtaaaggtgacggtaagaagaaagaagaaattggcttctttgaaaagtatcttggtgctagtgttaagagcagaattgaatctttcacaaacgatggaaagaagcaagactcgctacaagctacccataataaaccaacatctgagacatccaaatgatggtactcttatcgaaaagattttattatttgtaaatattatgcactttatttataaaatactacttcatgtaaatattaatattaccgattacaacctatgctgctcccctcatcttctctgagttgatgacgtcttgacctaaggactccatcgtctccgattcaattaactgtcccaagttaccataagccattgaagcctcatatgcggatattattcttggctcagtgataccgagttcgcaatgtgctaacgccttaattacgtttgcatatcttgtgattgtttgcctaacgcttacagtaacagtatcatttttatccgaatatatttcccaagaactctcttcttccaatcttgtaatggaaaccgacattgcattgttggatcctggtaaatggtcagattgtcctgaacctgtagtagtggtcttaccggaaagatccatcttggaggatttccttatccatacgaacccatttacacccaagataatggtgacattccctggaagattatgtgtatgatttttagatctcactattagggaacttgggacttgaacaaacgtaccattccttagtttcccatatttcaacgatctggtatgtaatgaagctgaaccgtcttggaacaacgattggacttcagcgtttagtagatcaccttctttcaagaagtttctcatttgcaactcatctgtctctgacttacgtctcaatacaccacctggtaaattaacagaacccaacatcaaaaccgcatactgtttggctccaatatccactttccaccttctattaccaacatcagtgattctacccacgatgtggtcacctgtttcgggaatataacgagattttaatggtaaaacggatagcaatctattcactctcgatactgtgccaaccacagaactgtatgtcttgttttccaagaaataagtaccatgacccttcatccatataggatcatcggttattaattcaccaggtgtgacaatagacccatcctgatggtctattccaccattggaatcgtgagcaccgctcatctcaatgtcatgttcttgctctgaacctgagctggaatctgattcatattcatcctgttctaaacggccattagaccaaaattcgttcctattgataacactaataacatcactcattgttccaagtaatgatataacgatgtcagggactgcagaaggcgttcgatgtgctgacttcctcgctgtacctttgttacttttggtgttagttaactgaaaattttccaaattaaataagagagcgatgagatgagatgagatgagcgttgtaaaagatgtaaaaatgttgcagcaaagatcgaccgtcaggcagcgttttatttggtgaagtgatagcacactattttgctccatttttcaaggatagaggaggactagttttatgaggtttggcctagtgcttcgaagaacaatgagtagagctattgaaactacgttcaaatatgaaccaccagtgcatcgtggcatgaaacaattagataaatcattattcgtaaagaagcttcctgttgttgtattgctattgaagaatccaaagaatatttctgtcttcaccaagaagttcaaggacgatatattaaggacaccaagaattccattcgttataagacttggcgaaacaccaaaagaagatactgataagaacgatgtcgagccagtacagaagaaaagcaaatccctggccaatgacaaccatataaccaaaggtatcatactaaaagacagtatacaagatgtttcgcaggcgagagggaagttgacctccaatgcactagaatttcttgatgagcaagagtatgagttgagaaaccatgagtatgtgctagattatgacttctggaaagtggaagagattctaaatgcaattttaccagaggagtaccttgctgagattcctactgggttcactattgtgggacacgtagctcatttgaatttaaggaaagagttcaaaccgtttggtgaaataattggacaagtcatcttggacaagaattcgacgatcaagaccgtggtcgataaagtggattccattgctaccaaattcagaactttcgaaatgaacgtcctagcgggtgaaccgaacctgctagtgactcaaagggaatctgattgttcattcactttcgatttcagtaaagtgtactggaactcaagactacatacagaacatgcaaggttagtgagtctattcaaaccgggccaaatagttggtgatgtgtttgctggggtggggccattctcagttccagcaggaaagaagaaggtcatcgttctaagtaacgatttgaacccagaatcttacaagtacatgcagcaaaatatcatcgacaataaggtgggtaacttcgttgaaccattgaacctcgatggccgcgaattcatcagagatagtcccaagctactacaacaattcatcgaaagggtacagggagtcatcacggtgccaggaggtaagaagtacaaggataaagtcacgggagaaactaaacgtactcctgaaaccaagatcccaatcaaaaaccagttcttcgatcactacgtgatgaacttacctgacagtgctcttcaattccttgatgaattcgtcggattatattcaaggtacgggttcacatacgaacagatggttcaagaacacggcgaacagttccaaaccccatggatccattgtcattgtttccataaatacgatgcggaagaacaaccagaaccatccatggaacaactacacgaaagggtctaccaacaaatactacaaataatgaagaccactgagcaagagcttccgttcaaccagttccagttccacttagtgagaaaagtcgctccaacgaaaccaatgttctgtgttagtttccaactaccacagtcactagcctttatctaactatcttgatacataattgcaatgtaaatagaatgcaacataccagtgactctcatgattgcagaaaacagtcaccaaaacaagtcactggcccagtgtccctcagtccatctcttttatcatccgtttgtctttactctgtccacgtgaccagatgttgccatctgtgagtcatttccatgtctcgccctcgaggcaacagaaattgaaagatgcagccttcagaatgactaaccttctcttgggaaagcaacgagacagggagtggacgttcggttactcattcctttggtatttcagggttacggagcaaggtctgtacactgtggctggttaagagttggcagttataagttttgggattctactgatcacttttttctgtgcgtcatccgttctctgttatcactctcgagggttttgtccaagtttgagatacatatataagaaggcatttagtgtccattatcgaggtcttctagcagtcagattatactactattgaagcggttttctatctctcagataaagtatcagcaaagagatcttcaaggattctctgttgaaatacggcaaagatacacttgtccttcacaaacaaaacagatacaaaacagatacaaaagtgacatagacttgacggtttacacatatcatttcatttcctttctatattttgggttctaatcatttttttggtcattaatacgttaacaggttttacaattgcacatttcatcttctcattccgcatcacttttatttcgttaccagactagttcgttaaattgaaatttagcacaacagtcgttcattcatcatcagtcattcggcatcatcatttatcattttgggttttaagcagggaataatcaaatttatcaagtgaacataataaagagacaacatgttgtctgttaattaaggtcactctagcgattattagacagcaaatatcattactgagaaaggttataaaatcagtaaagatctttcacacgtttgattatcgagttaaactctttttatcctccgcttccgctcaagctttttttaatttctttggttcaacatgcagcatctcacgcctgttgacaagacgacggaaagcacaagttgccttattgatgacatcaagccgcatgaaaagtcgtctcacaatgctaaattgaacggatctgtggctactttattatcagcattgacttccaacttttcaaaccaaagaattaacaattcgaaacaattgatcttacatttcatcaatgaggtcgtcaagagatccaaatcatctcaacttgtagtcattcaagctacatatctgttccatcagatttataccaaggcactgaaacccgtgtccatcacagatatgccagagtttgcaagatgctcgaaaagagtcttcttgtcttgtcttattcttgcacacaagttcagcaacgattcgacgttttcgatgaagacttggtgcttgatatccggattgaaaccacgggacttggctaacatggaacgttggactctttctaccttggattacaaacttcggatcgaaagttcagtgcttaataaatggtataacaccgtcctcagcgaatcgttcgtctctaatcctttgctttcctctgtctcttcgtcatgcagaaagagagcaagatcagagtttgaaacggagccatatatactttctccatataaactacataaatgggaacactcagctacacggtaaatgtatgaatcacctagcttctaaacaaattctaccgtccattcttctttctccctttttgttttccattccgtgtggttaacattaaagattcaattaaataaacgattccggctttaataatgaataaacctgttttggacgggtcaaaaattgatctgagccagagagaatcagccctggaagctgtgcgaaagtgttgatagaatcatgttccatttggcacggagtgtatacaagcattggaatctacgagaacagcatgacatactaattctgggactcgatggatctggtaaaacctcatttatagaaacgttaaaagcttatttatccaagccttccaaggcgttgaacaagatccagccgacgataggacagaacgtttcattcgtatcgatggatacacaccatatctggaagattatagatgtctcagggcaagagagtttccgttacttgtgggattcttatttcaacaaagacaacatacatggcatcgtctatatggtagatacatcggactcagatagactacaggaatcaataaacgaattacaagcaagatatgtgaatactcccgctgcggtagatataccgatagctgttgttcttaataagactgaccaatgtcttgatgtatcatcattcatcgatcgattcaccgaattgatgatcgatcttgacgtgaagagattcaacgtcttccaaatcactacagctcaacccaacgatttacaagaaccatcagaatggctacgaacccaattacaagagaataaggaactcattccaccgtcatatagataaaatgatatgagtctcgtggacaaatttcttatataaaactgtaaatacataagtaagcatataattatctcatactacatgaataatgtactccagagcatcggaaataggttcgatcaatatgaccgatatttgcccagaatcccaacttgattcgacgagttttaaggtccacgtgatggtaccacctatctctttttgtttctcttcgttggtgatatttgtggtatatataaatatagatctaaaaagccaagaataatacactccctccctcatctgtgaaatctacaaagataagggaaataagagcacaagactgctctgtatttcacagttcgtaagctggtgtattggtcgtgccacttagaagtgtggtgattgttttgaaacggtctggttaaggtttctagtccgctgggtttatcttatcaaccatttcaagggagttttccaatcgggtcaatcataatttgatagttggtataataatgattacagaaggctcaaatttgttaccatccggtaacaagccgggaaaaaggtatgcgagacacattctttttggattggttttagttctagttgttttggccactttctcccataattttacattgaaagatcaaagatcaacgttgttcccagggttcttaggtggtcacaagcacccaaagaagaagaacgtaatatttttcgtttctgatggtatgggacctgcatctttgtccatgactcgttctttccagcagtttactgatgggctcacgtttgaccacatgttgaatctcgatgaattctttgtcggttcttcaagaacaagatcttcaaattcgttagtcactgattcagcagcgggagctactgcgttttcatgtggtttgaagacttacaacggtgccatcggtgtggatccaaatggacaaccttgtggtacactcttggaagccgcaaagcttcaagggtatttgactgggttggtggtcactacaagaattactgacgcgactcctgcatcgttctctgctcatgctgatcgtagaagcatggaacagttaattgcccaacatcagttgggtgaatatgaattgggtagaatggtggatttgatgatcggtggtggtagaactagcttttaccccaagggtgctgcagcttcaccatatgggatcagaggttctcgtacagatggtcgtgacttgatcaaagaagctgtagcagacggttggcactatgttggagatcgcgaatcctttaataccttatccgagggtgataatgtgaaacttcctttgcttgctttgttagctgactacgatataccctttgagattgatagattagattcggaatatccatccttgaaagaagaagctatgactgcaatcaacgcattgtccaaagcaactagggattcagaccagggatttttcttgttagttgaaggttctcgtattgaccatgcaggtcatttgaacgatcctgctgcacaggttcgtgaggtcactgcatatgatgagacgttcaaggctgttgttgaatacgctaaaaattcagacgtagaaaccgtcataatttcaacttcagatcatgaaacaggtggtttggtcacggccagacaagtttctaaagcatatccggattatttatggttacctgaagtcttggcaaaagcacaacattcgtgtgagtacttagcaagaaagttgattcaaaaaaagcttcaaacttctgagacctcaaagggcaatctagttaagttcatcaaacatgaaattgtggaagctggtttaggtatcaacgattatactgacgaagatatcaaagagcttgagagcttgatcgatacccctggctttttgatggacaaattgaccgatatggtctctttcagggcgcagttgggctggacaacacatggtcatagcgcagtcgatgttaatatatatgcatactccaacaaggacgggttgaagtctaagattttggataaacttggtggtaaccatgagaatattgaaattggtcatttcatgagaaattatttgggccttgatttgaagaaagtcacagagatgatcaaaaacaccactcatactcaggaatttgtatcttccgcttcagaggaaaactactttgaatacattccttcattcttgaaagaaatagaaatctaactccctgttaacatttataaaggttggaaaagacaaaacaattgcattccgtttcattgcataatcgtatgcgatctgtccccatagatattgcactatatctcctgctctttgtttcaaaactaaacgtggtaattgaaggtgttatttcgcttataataatagtacgcagaaatattaatagtattttacataataggtctaagtacataaagagtaaaaccaattaaagatcaagacggtaccttttcccgtttaatttaattgaggattcgttctacgcagtacgtttgatgctatgttctccctgaaaactcatagcgcttattcttcaatatggtataccaagtagttaggtagaccgaacacagaatatcccaatctttttgccatcttagcaaatgcttctgtctctatcaagtggtagaatgggaagttagtgaacatggcaccatctctgtggacttcagctttcactaaagtacatccacctccgacaccgtcaagttccattaatgagttggtggcaccgtttgcgtcgtagaaatgggccatcaatggtctataagtcgcaatttcagagtacccctccacgataatctcgttatctccaagttgttgggccaatttcaaaccgatttcggattcagcccaattattgaaatcgtaaggtctaatactttccttcttttgatctttgtcatagaatttttgatacacattagcggcaagaaccggtttgttatggctcgttaggtcttgaatgacggtgactggagtttcaacgatatctgcatccaaccatagaatccatgaagtgtgcggtccaatggtagagaacagcaattcgttcctagccaatgccatagcagcacgtctttccttttgtacttctagtgcgtgtctatccttttctcctagtctgtcgaaagactgagacgcttgtctcaagatggttatcttggcaaatcttttatcctgtttacctgtttgaacctctcttactgcagattctaatttctgtaaagcagcatctccagacgcagttcttggaataataaatccaagctcaatcaatgctcttgggtaagtcaaactcaacaaattattccagtactgttgatggaaagtctgcattggagtcaaaatcaatactctttccttgtttactaaggcattgctggtagatttcaacttgttcaaatcgtaatgggcaatgtgaccttcaggaatcaaatcgtcaactttatcattgaacaaccaactggaaactttcttgtatgaatattttggcatcttgtacttctttgtatatgggaaataaaatgtcttctcggactgatctgcccattgatggttcataatatcatcgctcaatcctagtacgttattcccactggaaaaaactaattgaaacacgcaaaatagcacaaatataggtaccacgatgaaaagaatcggcgatttcctcacacggtatgcgatcaaagacatggaagccatctttatgtttatgtttatgtttataaattaatcaaccaaaactatgatctatagcactcaattatcggctcaatttcctccttgattaattctcccaaagattagacagcgaaagtgtctatattcaacagagcaagacgccaatccgaccgtgtttatccttcttgaacttctagtaaactcgccaaattgatattgaaattacggcttttcttgttttaagctattcggaagttgagaattttcggcagagggtaactatactattctatcttgtttctcatatgtttctgtgtcccattttgtttctttcagtgtgaatttggtcttaaggattcgatttcgccgatttgaaagcacaagtcacgtggttttttttttcttaagtaattgccgaagagcaacctttcgaatcactgattaatatcttgggacgcacattgcttggccgggtgtattgaatagagcaccaaatgaaccaagacctgtgctaagaccttgggttaagagcttgtcatagcctcttctcatgcactcagtgaataaattggtattccagggtttacttgtggtaatagtgggatatttctgttggactgtgcataaagatgtgcaatggcagttattggaacagcaatgggtggatatgaagaaaatctctcagtgcaaacgatcttatgttgagaatagatgtagtgagggaatacggccggctttagctgggaaatgtgatgaatggtggcattgtgcgcagctggactcgcaccccagcgttcatcagatggccaatttatatgccaagacacttgcacacacgttaaattcgtttatacaggcacttgccttcaagacaataatagtactgatgctatttgtattgcttatatcaatttctagtaaactacttcagtagtttctctgtgtacatatatatcacgtataaagaagttacttgcgaagatcttttctccattgtttgaacgaatttgatagtatctcttctccttccaccagctgcttgtattcttcgtcgtcagactcaatttccgtgagttttaggtgattgttctcaaagatgagtttataggctttaattgtgtcaatatcgtcttctggtcttggaatacttgtcaataaccactctgtgaaggcaccataccattttatggcatctacacacacagtttgcatctgtgggttgttgttcttcaatattagcggtacctcagatgtagtgaactcctctacagttttgagcatgaaattgtcatctctaaacccatatataattctgtttattcctactaggaaacactgtaaccaggttttaaacaacttacgttcgaatttatgcgcatcggaaacggtattgaccattgtggtacatttcaactctgcgtaatgcttcaggttgtcatctgaatcctctttaaaatcaaaaatacagtccacttctgcaccgatcaatatcttacatttacctattcctgttctaaccattgagatgaattggtccccattgttaataatctttttaggtctcttttccaatgtagttctgggtaccaacggtagtggcagcgataaggttgcaagtgcttcaaatttgtaaccactgtaatatgcccttgcctgtaacgactccctattcttgttaatggaggtttccgaagcgtctgtcttgacttccttaatgaatagttgtccatcaaacgaaacaatacggaaatttaccggattgaactgtgatgaatcaaaagcactggagatgagcttccgtatgatacctctgaacgtaatgatatccaccttcgtcttcttactcttacgtctctcatactcttccaaagtcgaaagtaatccatgcaatgttgtagagtcgaattcttccgtattacactctttgaacttcttgattccacttaaaagatcaagcttcttgtctagatccgtatctggcaagtaatagtatgctagcctcgaatcatcgttgactaaaaatccattgtcctgtgttctcgaataatgacctaattcttttggttgcttcaaagcagtagttgtacttcttttttgaacgaaaagactggaagatagtaccattatgcaagaagtctattcaaagctaccaggttttcacgttctgaactagtcaccactatagaacacctcctcgtcaaatgttttcttacatgtgtcttggtgatgagattcttttaaagctttaaatgcatgaaaaatttccaattgtaaaggccttattgtatgctgtctgcaagataaaaagacaaagagagagtacgttaaaatacaaaacaaattatttccctaggaggtatcactgcaggaaactatcctggatagagatattatagagcttttaacaattcaattgctattcattacgtgtttgattacatgaaggttctctatttatcgttgataatagactagatacagtgcaatgaccggttgataatgataatacaatagtaataataataatataatataaccagggacaaaaagaaaataataagatctcgaaatagttcgtgatatgattgataatggatcaaacatggatttattctttatgtcaagacattagttttttatgcatttgtcagactgtacttctgccttgccagcgatgagagtgttctctcttattaacaaaggccaaagaggagttataaaagaacattaagctgagcgagataattgatgctctagattttgctgtttctgttgctgttgaactctactgcgaactgaggagacactgtataaagcagcaccttctccggtgacaccaacacctgacaacatttgttcttgttcttctgtcttgtaatccaatgcattcaaggcttcttcatccttgttgtagtggtggaaacatagccagaacaaacaaccagcaatgaaacaagcaacagccaaaccagagaatgtccagacgtactttggattttcggctgttggggacaaggcgataccgagagcagaaccgacagcgttcgtgaccaaaaagatggacatgatgaaggctttcattgtggctggggctttagagtaagcgtattccaaaccagtaatggacgcgaaaatttcagaaagagaaattaagacataagcaggaacttgccagccgatatggactctgtttggagtgtttgcgtattctggtgcacaggacattgggaagtcgtaacatggacctgctttgtaaataaagtgttgcaagacagcagcgtaaaccatggcactagaaccgaaacagaaaccaatgaagatcttggtaactggtctgaaaggagtgaaacgtctgataaatgggtaaatgaattgttccatgattgggatgaatacaattaaagcaatagagttgatagcttgtaagaaatcatttggcaaaccgtgcaattccatagtaccagcttgggtaacgaaattgttaagcatttgaccgtaaacaacccagtaaattgggtaaaatgcgaaaactttacaagccttgaaagctcttctaatttcatcgatgaataaatcattccatgggtactccttttctgggttcaaagatggaacggctctattcaaattgaaaccgttgcataaaccaatccagcagattttgaaacatcttgcaatgacatggtcaccaatgggcctcctcacgtacttctttctaccaaacacaagcaccacgataccgacccagaagaaacagaaagttaacaaataagcagcccagaaaccgtaactagcttctaaatgggtggttgccatgacagataaagaaccaatattaatcatcaagtagaagaacataaacacattttgcattgtaacattgggatcttcgatgactttttcaccgttcttcaaaaccttaattctaggccttgtctttgggatttgatctgcgatcaagacggacaaattagctttgataaaaccagtaccaataccgattataatcaaagaaacgataaatccacccaacgaggagtttttatcgttgatacttgggattgcagtcataaacaagatcaggataccaacaacatagaaactggcaccaacacagatagtattatatttaccccagaaagtatcagccaaataaccacctaacaatggagtaacgtaacaccaaaactggaagaaatacgacaaagcagtggcaccttgtgatttcaactgcaagacaccctttggtgtgtcgttaggaccgttttgcatatagttttggaatggtgcagaaagaccatagtatgagaatctttcagccaattcaacgatggcaatcaaccaacaagtgaatggaatcctttccgacacatgtctcaaagtactcaactcttcttcggtaggttctcttccattttcgttttggttgtcatcttcgtctacagcaccaataaaatcgattttatcagaactagcatgatggtcctttgaaatatataccttgatgtctgtgttgtttttgaatttttcatctttcttctcaccagtaaattcatcatcactactaactgtgctgtcaacgttcaatgcctgactgttgttgttgttgttgttgttgttgttgttgttgttgttgatgatatcatcactaattttgtcgtctgtcaagaaatccttttctgcggcggacatatttgcttgaacaaaaggtacggtgtgtgtgtcttataagttgagagatggacctttattggttggacaaaaagaaaggctgtaaccgagaagacagatttttgacacaaatctgtaggcatactcggaaggagaatatgtcaaaacaaatagaccagtaacacgtctttatatatctacttcaagagcgaaagaaaggaatgcaagtcaggaacgtaatgtggaatcaggtcttcgacaatgataatggtgtcaaagacaaaatacaaccaaaaacaataatatactgtgtatgtgtggtgcgaatgttttgatagatagagagggggatagataatgaatggattaaattaacatattcgcccgtacgagaacataatagcgagggaactttctttattatattttctttttcttttgctaaaggcagatagataggaccgaaagagagagtctggctgtaggcaaatgacgctccatagtattttaaagattctctatcagttgatgaacacagcacttgctccaacaccgttttatttttttggcgcgtgatgataggataaacggtcctcggaaagacatgagattagaaaccccacactcgggaaccaactaagaatgacattaccggtcggtatggcgaaagtgggcaagacacattcacgttactcctttttcaccttgagcgaatagaaacccccagagtacacaaaaattcgaatggcacattctgtgacacaatttgactttcttttcttccttcccaatttgataggatgctagctgctgctactactactactactactactactactactggttactgccgtttcaaaatgattaattttggcttcttactacatttcatcacagttcattatattattcgaatattgacataaatagcgagacggacattggaatgggtagagcccttatcagtctactctccagagtactacgatagagataaagaaatgaaaacattatacaggaggtctgtaaaatcgattaccattgattgctgatcaagatttgcgatgaaaaatttttcttctttccgttcaatcttgctttgacaccatttttgcttgacagctcgacacccttttggtgatgaaagaagcccaattttttttgacacaatcccacagttttcctttggcacattcggcacattcccatttttataagccgatatgagaaccagagtggaggagagctggctcacttcttttttttttttgcttgatttgcctatagaaaaggaaccggctattcgggtccaacagggccacttgatggcacggctctggggaagttccttttttttgttacgaaaacatagtagaaatacaatactaatcggccgtctgatcctcttcattccgttaaaatttgtaatgggattatctctatcttggatatctatgtggcatcttttgatttttgtgtgtatctcgaaggcacctttagagacgatagaaaatcatctgcgtgacttaacgtctgagaaaatgtgcaggcataaagtgacacaaaaatgcgaattgacatatctaaaaaaaatttctgaagttaaaaataatacaagcttaatgttggggtttttgtggcaaatcggtttcctaattaggaaaagaatccgtgaacgagcctcgagtgaagagttagcttttgctaacagttcgatatgtacgcgtgattctcaagcaacatttctcttgattttcaataacgatctcggctcttccggacaggtatgtcctatgcataaacgtttccttttctttctccgattactagtgctgtcacataaataaactcaagatgataaggccatttagtaagctacccaaagctgtgccgtttgactttatctttctctgactgactctgtctatcaggttgagtctgcagtagcattaacttggtaccattaacataccagatacggagattaagggcaatatagatatatcgtaagacgtatattttgacaagatcttaaataacagtgagataagccagtccctttgagcttaattgttgttattatttgcaattatcgatataatattgttaattaacctgtgtaaacgatataatttatggctttaaaatacggagtcatatccagcttcgcagtcatttctggattttaagacaatttgtcttggtgtgcttgtgaataatttgatagcatagcatcgatagcgtcttcgccgacagcttcgacgaattcttcgtctgtcaaattagatttaggaccctcgtagaattttctttgccaaacgaaataatatattagagatagaacccagaatccaggtccaataacgactgtgtaattcatggtctctttagtgataccggatttgtcgtaagggaacatgaccattaggactgcgaaaagttggaaaaacacggctaaccaaccgtttgccgtggaccagaagtgacccaagtagaatggacctggtctgaaatctttcctaccgtaagtgagtctcaatgcgatagggaataccaatgccatatacataccggcaatagatagagagaatagtgcatctgctgctgtatctccggctaaacatagagcacccaatgcaatggagaagaaggatgaaccccagatggaacgcattggaacgtgggatctttcgtccactttcttgaagaatttagagaatgggatgccgtcatctctggcaaaggcccagaattgtcttgagtttgccaacacagtggaggcacccattaagaattgacaaatgatgataagagacaagaacgttagagtccatctcttacccaacgcatcttggaaaacttgggtaataccttgaccatatggggagtttacaattgcgttcacatcagggttcatacaggctaaaatcacaatacagattaaccacccaagaatccaacatgaagagatagatgcgacaatcccgattggcacagctcttcttgcgtctttagcttcctcagccatgtgtaaacatgaatcgtatgcaccaatggtccaaatggccggtgttaacccgttgatacaccaggaccagcctgtgttccaatcagttaagttttgaacatccccgaagatgtacgatgctttgttgaacgatactttatctgatcttgagacaccaattggtagaacgataaagaataatatgattaaaaacacgtttgcgatgatggaaaacgtttgtaacctagcagtgatcttagaattcatcgaagttagcacagtaatggctactatacaggcacagaaaacaccatacgtgatcgggtcggtgacttcgaaatctggatttcccaccacaactgctgacaagatctgttgtgctaacccgtagacaatggaacaaactgatgcacatagcgataaagtgtctaagaaaccaacactgtaactaatacacttcctccatttttctggagcccattgataacatgctacgtacactgccccagcagttggaatagaactggaaagttcaccaagtgcgataccaacactgagaatcaatccaccggcaacaaaccaaccccaattcaaaccaactgcacctgcagctaacccaccgtccatggtagacgcaatagaaggcagtagacccataatcgaaaacgcaacaccaaaaatttgtactgtagaatattctcttttcaattcttccttataaccgatttcagctaacacttgtgtatcggacgtagcacttagtgcatcgatatacctgataggagcaccatgagcactggttactactcttagctcagaaactgaaccaaaccctatttcatcgttggaattatttctattgatcaagtgctcaacggcaccactgcttttactcatagactcttgatcgtcacccattcctatggtatgtaactatgaagtgtcttgctgtttttttagagctaatgttttctatgcactcgagagatgaaaacatccatttacaggtacctcgagagacaagaacagactttgttacagatctatccaacccttaaatataatttctatgatacagaactaactcattacttgcaatgatcattaaaacttacaagggaggagatcttacaaaacttatctatccttatccgtttcactcttgcatcgcttacgcatgataagattggtccaagcttgaataaataataccttaatatctgatactacaaattgttctttatgctttgggttggataaacctccgcttcttcacgactcatttcggttgccatgcatcagtaaaggtcgttttcttttccttcctttaggtccactcttagcgagcctaatccaatatcaacaatttacactgctgctgctgctgctaccactactagcacgactgcattgagctaacgacactcctcttgttcgtcgttcttactcactctttctctcctctcttatctgactcgcgcaagtacccttatcgttatcatgatacagcttcttcttcatcttctaggcgaggaattggtcgaaacggaaaaaagaaaaattttcgctgggaaaagctttcgttgcttggtttaatggaagggcattatctttggcactttgcgcaactgttaagcgagctataggtaaaagtcggaacggagagggccttgaaaagtggtaactcgcttagcattgagtgatgatagttactgcacagtcgcttaacggataaatgttacttttattattattttcttttttttttccctttgcggttcttgtttcctgacggagatcactctttcactaacagagttgttttgatgcttgtgcaaatattttgataagttgattgaccggaccagaccgccttaagggaacggtctctttctttttccggttttcatttgcataagtttccattcgagcaacaaatatgaaatgagatgtgggtgtttgggtgttaataggaatgatatttgcattaagttatttcagtgattgtataaatgtatgtaacaacagtgttggctagcttcaaaaaaatgtggttggggccttcagaggagtaaggaagtaggagagtggcaatggcaaagtaaaaagaactagaaaagttaattgacgtgtttttttatcgctttttcttccagggtattaataattttttaaatctgtcgcgcgtcagcgaagaattaatttatattattctgtcgttgggaataaaaattggaaacataaaccagggcagatcgacctgtgtcattaactctcgataaaagaattattaatgtagtggatattattgttaattgggtcagaatagcagacggctagcttgtgttgatcaaaagttcaaaattcgtaagatcaaaaatcaaaaaggacttaattaccggtcggttcaagcaacgacacattgtgggacccagacaaaacctgggataatccagttttccttgttttcagcggattcattttgggaagcttgttgagttggttgcatttttgttacagttgtttcttgtgttgtgttgttgtagtttgtgattcgttctaatcttttttactgaatatgtatcacaattgaaccaaataagattcagaaccgctctatttataacaaattatttcatggagaggttaatgtaggcttactcacccgctcctgcagttttgttcccatttttaccttttttaatatttttcacctatgtaattacctatttaagtaattacgaaggtaccaactgtacaatgcgtcgttaattgtaccgtttaggtaaagtaagagatagtagaaataactttaaaacatgcaagtgaacagagttgaggatgcgctatacctcataataaagcggctgcccttaatgaggtactgaagttctcctctaaagtatacagaaaaaaaaaaacacacactaccatgaatgacaacaccaataaaaatacagatgggcgtcagtcggcgctagattaaggcatcgacattattacactaaggaaaaacttaggatggacattaacaattgttaatcactgaaagaacattcattataatatacaaaccattcctattaactttatattatggagctatttagaaaaaaaaatgagaagtgggcagatgttgatagtcatgctaccacacattgtgggacccaacgaaacctgggataatccagttttccttgtcttcagcggattcgttttgagaagcttgttgagctggttgcatttttgttatgtcttgttgtaaactttaacggtttttggtcttttaggttattcccttgaaatctctatatacaacggaaaacaatggggtcctccaaaaataaggctctcttatatacagaaatggtaccgaaggctttaaaacatgcatagatctaccccataataaccaaaagaagtgtattaattgatcttggtccttgtagttacttcattgggtaattacatagctcggcaaatccaaaagaaaataaagatctactgaagaaatctgtagcatatgcatatatagcctctagcaaccagggactagtacattgtctattaacctcactgtagttttcaagtccaatctatctctcacataaactgcgcagctgatgacgatatcttgtgatttattggaaagcgtttcaacttcgtctaaagtttccacatcggcgattgatatgtaatccaatttgaaatcaccagtctggtaatatgggatccatctactctgaatagcatcaagtacatcatctctagtaacaccttccgtcgcctgatttttaataatcagttgtgccccgtcttttaagcctttgtaaatgttcgccgctatctctagagattcttcgcagagatatttgttcctactgcttaacgctaatccactggttgcagatcttgtgatcggcatcatcacaagttcaagatcaaagaataattctttgaccatgttttgtaaaacaacaaattgttggaaatctttctgaccgaaatatgccttggtgggttgaactatattgaatagtttcccaaccacagttgcaacacctctgaagaaatttggtcttgtcttcccttctagtttttcactcaaccccaatacactgataaagggccccacttgcttcgaaacgtccaaaggtatacctctagggtaaagatctttaggttgcggaacgaagacggcatcaacaccaagttcctcgagtaatttcttgtcagcatctaatgttctaggatacttgtccaaatcctctgtgggtgcaaactgcgaaggattaacaaatatggaaacaacggtgaacttgttatcttttatggattgctggatcaatgaagcgtgtccttcatgaagacaacccatcgtaggaacaaatccgacatcttcatttctgacattctcttgctttctccaagccctcacctctgcaactgtacgcaaaacctgcattatttcactgatttgaagctcaattacaattgggtgctaacagtgaaaccccggcaaagtaattgaaactacaataatagcaattgacttgactatttcttccgatgagtcttaatgccaaataaactgttcttaaacgattttcgagtttaagtgctgaagcaaaatcacgtgaccttaagcataatctcgaaattcacacaaaaatgaaaacaaacaagcagataaaatccaaaacaatgaacatcgctgatctgaaaggtttacatactggaatccagagcctaatatcgcattttggaagtgaaaagttattaagtgctagtatcgacactctgggatatcgtggttctctattctctatcgaataaggaaggcagaatggatgaattgcgagatatcagaaccactggtcctgaggatgtgttgaatagcgtcgatccgtatagatatacatcacagattcctaatggaaagagtaataatggattgaatgctaaaatgaatgggaataatacgttaaccaatatgattaataggagtatagccaaaaatatgggccaaaatgcttccagtggcagcatgcgtcggtctatgagacagagtttgagaaactcacttccacgtagttccataggtccacaacaacagcagcagatgaattccactcaaaatagtacatatcataatactgcaagagatccgaggccacttagggacaagaacttccagaatctgttgcagcaagagattttcagttatctaacggatcagaaatttgatgtcgagactaaccatccaatctctttgaagtcattgaaacagccaacgcagaaagattttatttatatgttcaaatggttgtaccttaggctggatccgggttacgtgtttacgaaatcgttagagcatgaagtttattcgattttgagaactattcattatccatacttggccacgataaataaatctcagatatcagctgtgggtgggtccaattggccaaaattcgttggaatgcttcattggttggtaataatcaataaaaagttggatgaatgtctagagcatttggatgtatcaattaacaatcaagtgacgcaagatattactgtgctaaaccagcctttgaaaactgccgaagagcaagagaagaaacaggaaaaatatgaattaatggtagagagacttttcattgactatattaccgagtcatataaaagttttcttagattagaagatgactacgagccttacctgcatgatcttgaattgagtttccagaggttcgtccatatcatcgaaacggatatagcccagctgacatctaccaccgaacatttatctgttgaatgcgagtccatagttgccaagaactatgagctgaaaaatattaaagagaaaaacacaggattggaacaggagtataaaagactaagtcatggcgttcagattacccaggcgaaaagtaaggaatggccggataaattgaaggaaattgaagacgaaatcgataagaagaaaagagatatacggcaagttagtttacagatagacgaactgacttctgttttgaaaagaaagaatataagtggagaagagattgaacacaagaataaggaaagtgatagcatatccaagagtttagacactgtttcatctagattggaccaattcacagggttagtgagacaacaaaggttggaaactgaatctgtttacaaaaatctacaagacacgttaaagcagtataaatccgctacggaagggctagtaattgcaaggaaaaatctcggcgatcatattgatgaatcatcaattgaacttgtgttaccatcagatcttatgagcgaagaaatgataggacttactgtcgaagagctcataggagataagaaatctttcaccgatccaatcaaaaagaatttgaataagatagctgaagacataaaaatgcgaataacaaacatacaaacggaaaactcgaaattacagattaaactggaggacttgaggaatgaaattacgacaaaaaacgaagatctggaccaactagagcaacagttatcatccataaaatccgaatacgaagaatacagacaagaatcccagagtcagttactttctcagaatatcaaaattgaaaagttagagagaaagattcaaaatgcacgcgtcgaatcccaacaaaagatatccagcatagagagagaggctgaggaaacgagattgaaattggaagaactgaaacttctacagaatagagaaagattagaacttcataacaaagtgatacaacttatcgaatatgtctcaaatttcaagattaatacccaaagttcaattgaagaattacaaaatgcaacacaaaaagaactccagcgtctgcaaactgaagtgtaataaaagctcggaggaaatcatttgaaataaattacaatatcaatactgttgaaattcactgtgcaaaagcaatcatttctttgtttattttagacagcggacgaaaacatctttttatagtgattatatgtggtatatttaagtattaggattttataaaactgattcgtgatgcgatttttggaaagatgattcatttgctgtttaaagtatgccagtttaatacggatgataaattataaaacccaatattgttcatttatttgcacttctatagtacattttacggatcaatggatgatgatctcttaagtctttattcttattggaactgtattctaggtatgccatatcctcaccaccagccaaaccagccaaagatccttcgctcttaacagccttagatttgttccttggtctcttgttcccaccattcttccaaatgtagctatcgttatcctcacctgcttcaatgcctgcagcttcttcgtttttgagaagaacttcttgcaaaagttctctacgttctctagcagaagaatatgctagattaggcaagttttccataccatgtagatgggtgataaccttgaaagcataaccttgatcaactaaaaatgcctgtctctttgtggagtagtacatttcttgagtatctttagaaactagagaatagaagaaggcgttgaacccttcatcgttacgtctcttagctcttaaaattctacccaatctttgtgcttcttgacgtctagacccgtaatgagacgaaatttggatcaaacaagtcgcctctggcaaatcaatcgaagtatctccaacctttgataagaaaatggtattgatttggtcattatattgaaaattctgcaaaatattcatacgctcttgttgtggcgtggaaccgtaaatgaaaggcttacctagcttcaaagcatattcttgaagagcgtagacgttatctgaaaagacgataattttatcacctctcttttcatgatattgaatcaaaaattgacacgcctggaacttggttggattcataatatatagtagcattctttttctcgcattctctcttagatattcttggtaaaactctgcagtcattggacaccaaacttccgcacactgcacattagcaatgtgacctttctgtgaaagttccatccaattagcttcgtaaagttttggaccaatcaagaaattcaaatcactaatcttgtcatcttcacgcaccaaagttgcagttaaacctaattttgcatgtgcggcaatagtggacacaacacgtctaaacatggctgcaggtacgacatgtacttcatccaaaataatgaaaccccattctctacccgttaagaaatccataaccttttgagaatcgtacgatctatttctagtgttagcaaccatggaataagtcgagaccaccagaccagattcagtttggaacatttctttgttatctgatgtgaagacggcaacattttcaggctggagcgtacaccactgaaggaattgttgtctccattgcatgactgacactgacgaagtacaaagcacgatcacagactttttgatagtacatgccgctgtgataccgaccaaagtcttaccagcaccgcatggtaacacaataataccacttcttgcacgaccgttaccgaacattttgctcaaggatttttcctgatatggtctgatttgagttgatggtttcaaatcgatatctaaatctggatttcttcgatcgttcctgaaatcatattcttccaacaccggatagtcaagttcttgacatcttttcttcacaatttcgacagatgcattgtcaatttcgaaagcatgaaccgcatctatatcatcgtcttcttcttcaagttccttattggcccccacgacagctgaaaagacagcttccacatcgttaggatccactccctctgcatctaccatcttattcgccatggttttcttaaccgcagcatccactgcagcatcggtatcgattcttagattaccaatgatttgatcgtttaacaacatttgcaagatatcagcttgagaagtttccacgaaatatctattatgcttaatgaccaatttcaccttaccgtatgatacagttgcactcttaatgaagttgataatcgaaggtgcaacaggaaccttggacaatctgtccaatactgctatgatatcttcagtttccaaaccaaccgaaaccgcagcatacaaagagtaagccgtaattctgtactcatgaatatgagatggtctagaaacgggttctgcgatcgtcacaagaaaatcctgtgcttgttctgccaatggagagaatgattctaagatcacacgtccatcgttaggcgatatccataaaggccgcgaggcatgatccggcttcaattttaagtagctgaaatcgttagtcttgaacattcctgaaacaacgtcaggctcaaaatcagggggaatatcgtccaaatgtgcatgaaggatatcatcctttgctgctagattatggttcattccactaccagcagttgcagcagcagcagatctagaagaagaagaacttttcttcgatttccgactcaaaagaggattcacttgaggagcaggagcgttcgcctgcattagagattcctttaactcagcttcctcttcttcatctaagacatcatcgtcgatatctggggcaatatccccgtattcttcatcgtctgtaaccaaagagtcatctgaaaaaaccgtgtcctgcactaatttctcctttccacctctacttcttgtgtgatatgaacgcttcactacctcatcttccataatgacacaattagtgtacagatagactccggggatagaccttaattcccttgtccgtccttggactttgattcttaaacatctaattaaagttaaagttctcttaaaatcatctttcagattaataatgttgaggcaaaaatgattacccggacaaacaatataaccagaatgagccaaaaacccaatataagttagagttggatgaccaactaataaccattgcaaccactaggtagttccacgattaacaatacaacaacgaggttgccgaatagacgaaaaggccggttttgctagttgtttttacagttttagtagttgtaagactgaaacaacccatacaccacacctcaggacatcgtcacatagtacggcaaaagaaacgtattgaaaaaaaattcgagattaatagcgttatccaaacgagatgagcttgcgatgaggtaggttcagatcttatccaagagcgattacgataggatcaccagtggtttgggtgaggaaatagtctaatttttacagatgagtgttaagaagcaaagttccaagtcttcagtgccaaaattgacgaagaaagatgacaaaaaggtaaaatcatcgtcaagtggttcagagtctagttccaattccagcgacagctcgagttcaggttcaggttcaggttcaggttcaggttcagattcggattcggattctggctcagactctagttcaagctctagctcagattcagaatcgaactctgatagtagctccagttccagttccagttccagttccagttccagttcagactcagactccagttcagactcagattctagttccagctcagactctagttccagctcagactctgattccgactcagactctagctccagtgccagctcagaatccgatgatgaggacgaaaaagacatcaaaattaagataaaagatgaaaaatctgagccagtagcagtggaagtaaaggtgtcgaaatcgtcaaactcggactcggaatctagttctgattctagctccgattcagactctagctccgattcaagctctgactcagactccgattcaaactctagctctagctctagttcagattcagattcagactctagctctagctccagctcggactctagttcggactctagttcagactcagactcagactcagactcagactcagactcagactcagattcgtcctcagattcgtcctcctcatctagcgactccgatagcagcgatagcgaaactgcagtagaaaccgaaaccaacagcaaacgtcctcttgaaactgaatctgattccactgaaaattccaaagaatcatcacaagaaccttcaacaaagaaacaaatgatttcagctggcgttgatgaagtattgcctggacaaagaaaacatttctccagagtcgaaagagagaagattgcatttgaacacgaagtcctgacagataatacatacaaaggtgccgcaggtacctggggtgaaatggccaacgataagttgagccgtgtgagaggaaaagatttcactaaaaataaaaacaagatgaaaagaggttcttacagaggtgggtctatcactatggcttctggctcctataagtttactgattgatcaattccaaacaattctcacctaatgaaaaccataaactaccatcattcaccatcgtcatctaactctttggaataagagacaaaactgtttccaatatatacttacaatcgaaactattgtgtattaaactgtataaaccttcaaaaacctttgtcattgaacaataaaccgctttgtcaattccggaccaatatggacggaaccaaatgccacacttgacacgcacccaattaagatgcatagaagttgctgaaaaagctgtgaggaatcttggctcgaacaaacggattaggaaaaaagtttttgaaaagtcgcgaacggaaacgatgcacaccattgggtacccacatttttggccggtaagcattggttacccctctctcggataggcaaggttgcaaagactattacttgttacttttgtaattgccataaatagaggccgggaaaagaagtttctttgataagttcttcttcttctttacatattaattaaagtttcacaagattacgtatttgcagataaggcattattagcaagcaagaaagcaagcaataaaatcaggaatagaagcatcatgggtttgttagacagtgttaagagctacgcatcgaaacaaagtgaaagcggtgaagatttggtcaagaaggctgagggttacttgggtgaagaaagattgggtcaaatcaagactaaggtcggagaagaaaacttcaagaagttcgaagaccaagctagatctttcttgggtgaatcttccgaaaagaaggactctactgaaacctctggttcagccgaaacctctaccgagtctaaaaagaactaaggcaactaaggctggaaataagctctttacattgagtatataatttcataagtaacattaacagatatcctttctgctataactttaaaaccgcatctttcacaactttgatttgggtttatttacgactcgtgtagcgactaattctttgtacaatggttcgaactgatctctattgttgtgtaattcatccactgaggctgattggagttttttcgtaatgtggccaagaagcatcggtccgattacgttcggattttcaatgttcataagatggtcgacattgtcgatttggatgcgtttgtaatgaggaatggtgtcctgtaacagctgataattttccggcggacaccatttagatttaccacccacgtagcaaatcacggggctttcaatccatttcaagttgtcaattaaccagtaagcataggggtggagacacatgtacccgatgaggtgttgctcttttgaagtcttcgtgtggaatttcgatcctcgttttatcaactcagcgtcacagaaagtatctaaaatagttttatcagagtttctccaaaagctgcgcttcctcatgaactcctcgtactcgtcccttgtggcaaaggtgtcttgaaccatgttgctaatagcattgaaatagttgttactcaaaagcgtgatcttctttggacttggtgggttaagcatcttaacaacgggctccatggttatgataagctgaaacaagtttggagatagtataccgcaaccaagagcttgatgcccacccatagaatgcccaatcagtacgttgaaactgttttgttttggaggatttaactcaacgtcacatatcttgataatatccttagaaccatcgatccaatggaatatagagccaagtttcccctcgttggcaacacaggaatcaccatggttcacttggtccactgctattagcttcccaagcttatactggtatttttcagggttcgcttggatctgtttgtggaaatatttcacgtaccattcccatatgctctttgtcatacccgttccatgtagaaacacgatgttaacctcgggaacagctctaagatcctcagtttcgtagacatcgtagaaaatctcaagaacgtcggtcccactcaacgtactccggtaatcagttcttggtacagctgcagtcacccttttcgtcgattttatcatattattactgaattattaggggagttgtaacctgatatcaataatgtgccctaagagattacacattcaactgattatcaccatcaagcatcatggggacatacttataatccatatatgtttacttatatatctttatatctggatcaaactgacttaaagtggagaagaatatagaacttcggacataatccttggcaatgagtaatgaaacaaagaccgtttctccaaaagtatgttaaaggaaacaggcccaaagttcataggggaactctgcatgcagattaagcttggggaagaatactcttggttaaagcttattgtgtttagttttctatgaatgttagttagatatgtcagacttgtgttacaattagtttagagatgtatttgaattgattgatgttatgaagagattagtgtaataagaacagagaaagaatttagaattattaaggtaaaaacaggcagatatgggattaccaaaatgaagtgaaatgggtaaagagaaaaaaaggcattgtcatttactcgctttgagactctacgtcagtctccacgtcagtttgcacctccgaatgcaaactcagtttgacgggtttcgtcagttttggcgagcccagggaagggcgaggaccctgtttagagtcactatcatcgcttggattactagttctatctgaatcagtagtagtaatatcagaagcacttatcgtagcagcagacgtagaattattgttaacgggagggggtgttggtgggggcaacgccaggtcaaagcttcccgaaggtcttctcttgtgtggtgatgaaagggacataagcgtctctatcgcttccacctctgatggttgcgaatttgacgacgatgatgttctagtaatctttggatgggttgaggataacgacctttgttttttcttgggactttgtaacgctttcaagaacgctacctgcgcagaattctcaccggctaaatcttctaaatcatcctttagtttcaaccccatcgtatcgtgtgccaatacggactttgatgcatttctcgtttccttaatggcagaaggaagtgtttccagttccgtatctgaatcctgagcgaaaacgttgctataagaactaggtttcacctcgtttgtcacttgagcagcatcgtcaatcgattcatctaacccgcgtttcgaatgctgaagcatattctgttgcatcttgacgtatgcataatttaaccttgatttaaggttattcgaaatttcacgtatcggtttctgagtcgcaacaacaggtttatgaacaggactttgcaactctagcgatggcgaaagaaacagctcctggttttttgacttgggagtttcaggtggtatcagattggtaaactttgaatgttgtaaacctaccggtgattgcggtatggcgatctctccagagtgtgatgagtgagtgaatctttttggacttgccagagagggcgccccctcgagatttcccacagttgccgaagattgtctcggcgagggcaaaaaactaggcctggacccggaatcatttttattactgtcactcaacggtgaaggagtctctggagactcttcacccagcagtgagccggctctttgtctcttcggagtcccttccataattcttttttataccttgattaaacggaacaaataaaggatacgcacacagtgacagaagcttatagatggtatcaaacagtaacttaaagaacagttagtcggtaaatgtttatattttataccgcttttcaatatctcccctaaagtttcacttgtaataccgtaatatctcactggacagaaaacaaaataataactctctgcgaaaaatgtaatgttccaccggtaaaacacgtgtataactggtcacaaataaaaatatcaacggaacacactcagtaaaccgtgtttcgagtgccttaagacgcgttgatgatcttgttttacaggtttcgtcccttgttgccatatataagtccagtgtttggtttgcttgttttccaattaagtcatttcaataacaaaggaaaattggcgaccaagcatgttacccggaaaattaggataataccaatctggatcggtacttcaccgaggtaaactacctatctcatcgctgatgccgatcgttatggaggattttaatattaacattacaagtccatatatgtgtatatgtgtaaatgtacatacagagggatagagagtgaagaaacctctcagattcaggagaaatttatcagtctggttctcctcctagagatggtgttcgatcttctctgatctgctggtaaggacgatactccggtctcctttaatgtgttaatatcgtgcctgttgcagatcgtgtgttcgtggttaaatacgtagtagtcttgtccgatgacctttgcgcatatgtaacatttcaaacatgatggatggaaccgttcgttcttgtcgttctctagacactcaccttcgatgaatccgttgcacactttgcatatagagttattcttctcatgaaagtgtaattggcaataaggttggtcgtctaggatgtagcaggggactctcttcgagaatggtttggaacaagtgatacatttgaaacatccacggtgccactgcccagacaactcgttttcgtgttttgaatagataccttttccgacgacttctttgtgacagttacgacatggtccgtggcccggtgggtatacttccatcggagtttgttcgtgtaactcctgttgtcttggtaaggagtctcgtatcttctctggaggtgtttggattggctcgtgagattctttatggaaattgtaaaaagttggagtagaattactttgtagggacattaaggtgccttcctcgtcagggcgttgcatttctggaatatttatcatctggggttcgtaatgggataaatatgcgcttgatttttttaaatgggtttgttttgtacctagttccaatgacaactcttggtctggagttaaccctttatttctcgtcaaagtcacggtgtccaattctgcaatcagtttctccattgcagtaagtttaccgtccggagagttaagctcaggttcagctgatttagacacgatttcaggttcaacgacgactgacggtatctgctcaatttgtttgaggtcattgttaggatacaacggattaatttcttcttcgtcaacttcttctggtacctctgaatccattggctcctctggtgcctgtatcgagactactggtactggaggtagatcatgcacatctgaagtttcactgaccaaaatatttgggatcaaagctggttccggctcatcatggagcagtgctttactcaaagcactatttggagcaaaattcacactgatatgattgctcacatcggcatcatcaacggaagaatgataactatcccgaaggttatccccgtcatcctgactgtctcttttcacacttgagttttctgtcaattgcatgaacgattgttccacaggatcgatacctggtggaaactgttctccagagtcacccatttgcggcgtattataagtagacgaggaattgctctgtgcagtataggaaccaacagcaggtccagaagtgaaggggaatccactgccacctgtggttaaattcggcgagctcgccgatactccgggttttaacacatcgaaatcgaaatgtgaatgggatccagacccacggtcagatcctgattcattactcatcactgttccagaatcgttatggccattcaacttatagaacgtctggttcacagaactagtactgtgcgaggccttgttcagtttcgtcgcaaacacctttgagcgcgtactcaaatttgtactggagttgacattagaagtggaattcgaatttgaatttgaattagaatgcaaaccagttcccggtataaattcaggatgtttcgtctggctcacaccagaagcaaccctcgaggtatttcttgaaccgctcttggacgtactggaaccagatgtcttcgagaacgcaacatcaaaaccagcgcgttccatggctgtgcgatagcggacattgggcctcagcggaggaaacggactactattcaacggtacctgcatcacggtcactcggttctaatcaaataaacacacttgacagaactaagaccactggacaaacaactagcaggtgttgtgttcctttaccgatagcttatgattttcgaaaagtgacagattctcttaatagagagagattggtgttgatttttcaagatcttcgcgacttccgatgaagagaaggaacagacgttagacgtgacaaggggttcgctggactgggatctatgtaagtgaatgtacagcacctgctgcgtaaggtgctgtaatgttatgccaagtacattgaattaagtatgtacggtttcatgctagttgagaaaatgataagagctgcggtcttttctgtatgggaaagcagatctgacaatggggctgtgatcttccggtacaatgaggtgtctgggttcatccaagttatcagaaaaaacaatctggatcacgtgcacattacagcacgtgacttgaaatttctttcttttacatcgcttcgaatatgaagtcatctcagccagttatccaagagatgagatgagatgagataaaccaataggtttatacaattctaggaaccagcatcgatattgtgacgcccaaatgaacggtatatttgctattgagaagcctagtggggttacctccaacagtttcttgcaacaattgaagaatgctctcatgaagagcactattttccagaaagacatccaaaaggcagtgatggatagatcccagcaatacgccaaggagaccggtaagaagcctagtaaacggaagcttagaaaagtgtctcagatcaaaatgggacacggcggtacactggatcctctggcttcaggagtcatggtcattgggattggtagtgggaccaagaaattgtccgaatatttgggtaattgtaccaagatatacgagactgaagcgttattcggtgtagcaacgacgtctggtgatagcgagggtgatattataactgaaacctcggttaagcatttgacatgggacgatttgaagactgtagaggcaaaatttgtgggccatttgaaacaaactccaccaatttacgctgctttgaaattgaatgggaaaccgttgtacgagtacgcccgtgaggggattccactaccgaaggcgattgaaccaagacagatccagatctattctttgcagctgtttagcgattcactgaccagagatcattcttatccgattcttaaattgcaagatgttgaggaaagagaggtgttgaagaaattgaatgcaaatctgatggaagataaattgtacttctcacaagaatactgtgagaaacatggattaaaatctgaagaagttgaagtagggaattggattccacttaccgatgaggaaagagccagcatttattcttcgaaaaacgattcgtacagggctccgttacttcattttaagacaagtgtatcaagtggaacgtacattcggtctttgattagcgatattggtaagtctatgaagtcctcatgctacatggtgaaactaatacgttgccagcaacaagagtgggctttagataaaaataacgtattcacattagacgattttgaacataatgatgaggaaatatggtccaaagtcttggaaaaagtgttggaagaaggttccaaagtgaacattgaagaggagtttatcagggcaaaggctgaagcaaaggctgaagcaaaggccgaagcggaagctgctgccaaagttgcagcagaagtgaatgtcgaaactaccgaagcaactgccgctaccaccgtcgaaccagttacggtacaatccacagcagaggaaacaccgactggcaaaaggtctagagatgacgagaaaatgtaataatatctattatagtcccaattctttaacccatacaaacaaaaaataaaattttatatatatactgcataaacgaaatcgtaccttctatctctaatcatccttttcggagggatcctcgatttgcaaatcagctgagttaccaacgaaattgcatgtcaaatagctttgatcagtttcatagaaattataactattgagcatcaaatcagtataagatgtataactgggacacgtgaacccaaaatctggtggacaatctcgaagcattgcgacacaggtatccacacaaggtaagatctcgtaatagtctgaagaaggctttattagttcgttcaacatctcattccgactttcctctgcactccgatgcacgtaatatttggttttatcagttgtacaccgagggatgctaacagaacatagccagttcttatatgacgctgcgcaattgctgcactttcgtagcggagaatataccgcatcttgttctgtatcgcaggggatcaattgcaacgctaaactgaagtttgaataataagattccgctatggaatcgtagattgcggccaattcgtccttatcgttgtattccagtaaagacgaggatggtaccgaatatgcaacaccatcacaaaatcccaatccaaagatgagtgaacaagatgaatcatccatggtctcaaataattgcttagaaaatagaacaccaccagaatcttccaattcctttgtgctggtggctaatttctttgtgacatatgcaacgtacgtggttgacgaatttaagccagttatatggaattgttccttagcgctacccccgcgtaccgtaatagatttatgaactgatagagttgtagaagatagagatgcattttctgctgtattaccattattagttccgttcaatgagccattagccgatgaaattagataaggcccattctgaatggcacaaagggaatgagataggttcaaattatcaaagtattcggcatattcgaacccatagatgtatatatcataaaggctgacatcatagatcgaataattagatgtggtcttcgacatagctgtgacattaccagtaaccaacaaagcagaattgtaatcagtgtcaacgacatcaagccacggacgtttatcccattgaaagacaagatcacgctgagatatggaaatctggtacgaccaccgctcatcatcatctgcaattgtactaccatccgattcaaatggctgaccagtggtgctattaaccaactggaccatcagatacaacgtggaatacgtgccattattcagcgaagagtcgtcagtataatatggtcttaaggccaaagcttccaaatacccatcgtcaaatgtagaactctttgcagtggtgaaggtcccagtgtcgttagagttaaaagtatagtacaagaccaaagatgtatcgttatcaactttactaggccgttcacagatatttgcacttaaaaagatgaacatctcatatgtctgtagtaattgtgagaaagaatctgtattgttgatagaaaattcgaaatatgatttctgaccctttactagtgaagctgaaacaggtgcccattcttgcaatgaagcagaatcagaactgttatcattgccagtgacggtatcactggccatcaggttctcatcgagaaacaaatcaaagcagcaacacggaaccgcaaaaaccgtcagtaacaagtaacatacatatctccatagcatgatagtgcagttaccagtgatcagagtacaattactctgctacttacggatctctccctttattcaaagagcatgcgtttgaaccttatatatagaattacgacttgttccatttttttttcttccatttaacattgatgaaagatgagttcgagcatacacaaatagaaagatattttgatgggagtaaagaggtccacaagggtcgaaacagctctacccacatccaattgactgatcagtattagtaccagtcgatttgtaacaaaaaacagaaagaaaaacagcaactatggagagaacgagtgagaatttgccctggatcgaaaaatacagacctgagacactagatgatgtgtatgggcaacagaacgtagtgaacacggtaagaaagtttctacacgaaggaagactacctcatttactattctatggtccaccgggaactggtaagaccagtaccattgtagcattggctagagagatatacggatcgaattacagaaacatggtcctagaattgaacgcgagtgacgatagaggtatcgatgtggtgagaaatcaaatcaaagagtttgccagtacaagacagatcttcagcaaagggttcaaacttattatccttgacgaagcagatgcaatgaccaacgctgcacaaaacgcactaagaagaatcatagaacggtacaccaagaacacaagattctgtatcttggctaattatgcacataagctaacaccagcactcctgtcaagatgtaccaggttcaggttccaacctttgtccgaacaagccatcgaacgtcgtattgcgaatgtgttagtgaaggaacacttgaaattagaccctcaggcacacgcagcgttattaaggctctcttccggtgacatgagacgagcattgaacgtactacaggcagcaagagctacgctagacaatcctgacacagaagaagtcaccgaggatttgatctacgaatgcatcggtgcacctcacccacgtgaccttgaaaccatgctggaatcaattctcaaggacgactggactaccactacatacaccgtgaacaaaatcagaatcacaaagggcttagcacttattgacatgattgaggggatcgcgggcctactggaacaatatgaactgaaacctcaaaccagaattgaacttctatctagactaagtgatatcgaatattcgatctcaagaggtggtaccgattcgatccagaccagtgcaaccatcggaacgataaaacagtgcatggaattagaggtgtgacaatgtatgcacacaataagtaaactagtcagacgtataccggatctatataccatgtgacatgctgcgactgcgaaatcacgaaatagtgtaactttttctttcccgttttttcgttgatttaacggtgtcgagagagaagcaaaacgcgaagtttcgtctcgaacgaaaagaagttttaacggatacggtacttaatgcatgtatagagtttagatatgggtagattttcaatggggaccacgaaaaaaaagtgtcagttttatagttttggaaattacattacttgattgtgttttaattagcatttttctttccttggtcgtcttgataactgatgcagcttgaagtacggttagatcagaaggacaacgggtgaattggattctgaagatcacgaaataaaattactattccaagatcgcatagttttgggtatcaggtaccaccgcattgatgtatttactgtaagtagacaatggcagcgtgccttttttggcgcattgataaatgtgtaacctggagactcgcgaaggttcaaacatatataaaagagagattaggatcggaaggatgaagcatcttccagtactgcctgtcatgttaggcacaattttgggagcatatcgtaagagcccaacaagcctataaagtctaagcatgttcaagaagaagagtttggaaattctgttcgattcaccagtgagcgatgatatgatcaaatttttaactgatcacgctttgagagtgattcctacacagaacagaaaccaaagatacccaccttcaccaccgggcactccatccagtaagaaccacaatggagtacccagtctaatgacgttcatttcgagattagtacggtacacgaacgtttacacatccacgttgttgaccaccgtggtatacctaaacagattgagggagttgttgccctccgatgcagctggtctgcctactacatgccatagaattttcctagcctgtttgattctcagtgccaaataccacaacgattcctccccattgaacaagcattggaccaagtacacagatgggatgttcaccttgcgcgatgtgaacctaatggaaagacaactgttacaattgtttgaatgggacttgagagtcgaatctgaagagctatgggacaacttgtatgatttagccaacccaatcagaagagatttggagagaggtgcccagatcaacaagacgagacaaagagccaaggctcaagctcaacagaaagcatctcaattctactaccatcaacgcaacctttctgcatgttccagcactgctacactgctagggaacagcaggagtggatccattaacagtttggatatactgaaggaatacgaatcgtcatcgtcgtcgtcatcatcgacactgtcatctccgacatacaccgaggaaatgaactacaagaagtatacgatggatcctcggtactataacactgtacggccggtacagcacaccgaccctacaatatacacataacagtagcttttaaatataatagtgctagataacaaggggtgtgtgtgcccttggtcacctagcatggctcatcgcattaggcgatgccctataatcaatatggaaacggatttctttacatctactgtcccgggtaacttttcccaagcaaaaatttttcacttcctaaatttgtataaatagaggcaggtcctctgcactaagtacatatattacttgttaatgagcattttacagatatatatgaagctgaaaagagcaggcaacaactaccaacatcgggcgatgttggagttagtgttgaaggcacatcagtaacaaggtcgcgataagtatattgcgtcttgaggttccaaagacgagagaaacgctgtgcaccagtctgaacgtgctaaaatgtactctagcactctgaagcattaagtatacccaaatttctgaggaacgtttactgagaggcctgcaagtttgtatttaagaaaactgtatttaagaaaccgtactaggagcaacggcctcgctagaggccgtttctttgatatgatagccaatgtcacgtgatgccaaaaatccgttccatacaaaatataagaaaaagagtatcacgtgatggtacaccatcacgtgacgtaaacaaccctcaaagctgcgtgttatatagcgccaaccgggaacaccgctatccgcgtcgttattgccacttccagtaattgtccgagggcgaatgtcttccacacgagacaatccccgggtaatgccgcacaccttacaatgggaaatcaacttcccattgtagtaagaaaaaaaatttttttttcttcccttcgcttgccctttcccatggaacgttgtggaaaaaactcgacaacaggacacccagaatgcaaagggggctatgtcttagagcatgtctgggacacagaaccgcgcccgcccccgttttgtcttttgaaccgaaataattctagctcatcgatacacccatagacccataaacgcatcaatcaaatgaaaatcaaaaacaacaatttggaccgcatattcacttaaaatgcagtagcagcggagggcgcgttctaaaagtaggaaacgtctacgctactttaggattagccctctggaccgtgtaatgtaatgtcataccacttccatgtccgagtgaatgtccgtgtctcggtgctgggatgatccctgagatcccttgccctcgctctaataccggactcccagtttcacacatataaatagaggaaaacaaagtttaagatgcgatgccttttcccataccattggcggttgtttttgggataattttaattgttctgtctgacatattttaaaacagcaagaaacaacaactaagtaacacatacagttaacaatgtctgacaagatcgaagaacaaagagaagctatccaagataaggttgaagaagttcaacaaaatgctgaggaaactgctcaagaagctcaacaacaagctgaagagactcaagaacaagctcaagctaaggctgaggaaactcaagaacaagctcaagccaaagctgaagatgtcaagaaggaatctcaatctttttccaagaaatggttgggtaagttgaagaagttgtttaactaaagttaaaataaaaacaaaaaaagcttccgctttttttattttatttttaatcaactattaaagtaattctaacattccaaattataatcttaaccccattctcctctattattattcctactatcaccaacttaatatacatctttatatattgtctaatacttaataattaatatgcttcttcttttattcagtgtttcgtcatattgaacaatgtctgggcgtgttttgttttgtgtttaaactttcgttgtcttattacccggatttcataacaacctcagtttccacaacttagcacatcttttcaacttaaaagtgttgataattcgcatctctgtatatatatggtatgtagaataggcaatattcagcattgtctcagggaaggacacatcatccagcttgtgcatcaggtagaacacccgcaattatcatctgccatgtttcaacagcaaccccaggctcaagcggctcaagctcaggggaatgtgttctcggaacaaacccgcaggaaatatttcccacaattgaaaccttacttcccaaataaccaaggccagggtcaaggccagcctcaagggcaggctcagggtcaaaatcaaacccagggccaacagcaacaacagcaaccccaaaatatgcctcctggtttgcaacaaggaatgccccacccagtagtagaaaacaaccaacttccaggtcagatgcctgggatgggccaagggccaactgcaggaccaagttcagttcctgggccaggtcccacaccagcaggaataacacatgcgctagatgatccaaatgtctaccattggatatgccagctcacttacgggccaagcaaagaacaagcgcttctagaactaggtaagaaacgtgaacagtatgaggatttggctatcgtgctgtggtccagtttcggtgtgatgacgtcgttgctaaaggaaataatttcaatttatccgcttctttcacctcctgcattatcaaaccagttatcaaaccgcgtatgcaacgctttggtgctcttacaatgtgtcgcatcacacccagatatcaggcctcaattcttacaggctcacatcccgttgttccttttcccattcttatctacgacatcaaaccaaagaacttttgaatatttaaggctaacttcactaggtgtcatcggtgctctagtgaaaaacgattctgcagaagtgatcagtttccttctaaggacagatattatcccattatgtttaagaatcatggaaaactcttcagaactttcgaagatcgtcgctatcttcatcttacagaaaatattattagacgataacggactccagttcgtatgcgcgaccccagaacggttctacgcggtgtcacaagttttggcaactatgtttaagcacatgtcccaacaacaggtgccgggaagattattgaaacatgttgtaagatgctacctaagattatcggataatttagaagccagaagattgttgaaacaagttttgccgcaacaactaagagataacaccttcaatgaagcactacaggacgatgtaggtaccaagagatgtcttgcacaactactcctgactctagatgaacagcagcagtgatcttgcctgctatatcatatatatctccatatccatatatatatatatatatacatatatatcataattaaaaaacaagtgttaccctcactttcacacacccgcttcactttttttttcattccaaaggacttctaccgatttgcaaactgaaaacattatgaatataaatatataccataccacacggcaaaaagaattggataaaacacgaggttaataggctcaaaattggctactaaaggttagtacgtcatttgaaggtatcctagcactgccaattgcatgtctgcacaaacttataagaagtctgaggacccacacagtgggtccttgccagacaaaatggcgatctatcaggattgtttgaatcggttcaatgaatctcctgtgaatcctaaactgtgccgtaccctgatcacaagcttgttggaactattgtcgcatggtgagactttccctagacaagaagctactgctttattcttttccatttcgaaattgttccaacaccctaacgattctttgagacaaatcgtttacgtggctattaaggaattgtgtggaatctccgatgatatcttgatggctacttcttcaattatgaaagatgttcaaaatggttcagatctagtgaagcctaatgctattagagcattgatccgtgtcttggatgagtccactgcattttctgcagaaagattattgaaaaattcgttggttagcaaacatccatctatttgttctgcttctttggtcagttcataccatttattaccaatcgctgaaactacggtgaagagatttgctaatgagactcaggaagccgttggtgatttgaaacagttgccatatccagatgagaacagtagatattatccaactacgtctcatatctctcaataccatgcattgggtttgttgtaccaattgaagaatcacgataagatggctttgatcaaattgatccaacagtttgccggtcattcttcaccattgaaaaatcaattggctcaagtacaaatggttaaattcgtgcaccaattggttttgaaggatcctaactccatcccccagttcttaccactaatagctaattggttgcaaagcagacacgaggctgttgctttggaagcttgtaagcttactgcgtctctatccaacttggttcctaacgatttgtttgcagcagcggtttctgtcttgcaaggattcttgtccactcctcgtgtgacaaccagatttgctgcagtgcgtttgttgaacaagatttctatggtttcaccagagaaaattgtggtatgtaatccacaattggaatctcttgttaacgatagcaacagaaacatttccacttacacaatcactaccttgttgaagactggtaccgacaagaacattggttctttgattaagacaattaccaagttcatccacgaggtgaatgacgatttcaagatcatcattattgatgctattagaactctttctctaaatttccctgaggaatgtgatacaatattacatttcttgatggaatccttacaatctgccgaaggcagtcttcaattcaaaaatagtgtcgtggaagcattaattgatttaattcaattcgtcccacaatctaaggaaaaagctttagaagaattatgtgatttcatcgaagattgtgaatataatgaaatattggttagaatcttacatctattgggtaaggagggtccaaccactaagaacccgtcattatacgtgagacacatttacaatagagttattctagagaattctatcatcagatctgctgctgtgttgtctctttccaaatttgcacttgttaagaatgaccctgagttagtagaaagtattgaacagctattgactcaaatcaagactgattcagatgatgaagttagagatagagcatccattgctttgcaattcatcgattcggttaagtccaagaaagatgtttccaatatcgcacaaaatttcattcgcccaacttctacctatgacgttgttgctcttgaatcaaaactatcacactatttgtcacaaggccaagaggcattcaagactccatttgacgtctcgtcagttgccaaatactccgaagacgagaagaaggcattggatttgaaacgcagacaagagcaagccttcaaccatacagaagaatcttccaacagtggtgccggaaatggtaacggtactgaaaagggtggtagaaagggtgatagattggatgacaatagcttcaatggaccttcattggaatctgaagaagaagatttgctattgtccaaatacgtggatgaaatgtcctccttggaacaattccagtcctttggcaagtgtatccattcttccaagattgtcccattaacggaaattgaagctgaattcgttgtgaagggtatcaagcatttgtttgacgagcacgttgtattacaattccatatcactaacacattgaaggacgttgcgcttgataacgttgaagtggtatgccaacaagaaggattatcagagggtttacttgacgaacaagaggaatttgttttgcctattgaaagactcttacccaatgaaggagagtcatgttacgtatcgttcaagaaactaacacagaacaaggatgatatcattgtagaaagattcagcaactcgttgaaattccaatccaaggaattagacccatctacctctttgccattcgaagatgacgaagggttccaagatgaatacgaatttgattcattgttcttgagtcccggtgactacatgaaaccatcattcgtaagcaattttgccacctctttggaagaactaccttatgaatccgtctctgtctacaacattgtcgaaactaacacactacaagaagtcatcgacaagttagtcattagcgctggtggtttacctttggaaaactcacaaatagtatcccacgatgccacccaacatactctaaaactttcaggaaaatgtatcttagacaacactaaagccctgctttccatcaagatgatcaagacaagtaagggtattgcaattaaggctctagtgaaatccgacaaggaatcgttggcagaagacttatcaaacaacttgatataatatatgtacatttgaaaacaaaaaaaaaacctatatatatatatatctatctaagatagcaacataagtatttctcagccgtaaatataacgaagttctcagtctgataatcgtatttcagccgctcgttgttcaccccttatcctttagaccttatctgagacttcgagatgagaaagtcacaattttaaaggtttgttggaattcgaaacattttgtttacatcacgcatgggaaacaacaaaaaggaaagggaaagaaagataaagcaagagcaacagttcagcctttacaagttatatacctgctcatagaccaattcaagatctttaagatatctacaaggactcactaaggcctctcgttattatatcaagtcctgaaaccttcataaacaaaaaaaagaaaagctaaagcaaactccccttatctctaaaacaccctgattgaaccaccaagatgcgtttttctgttgtaaccagttacttattatgcgctgctgcatcgtacgctaatgcagcttctttattcggattaagtttcccagaaccaccatcagcgaacaaaccgatccctggtgactctcctttattgcaatgtgatgttgaccaatctcaatcgcttgatgttactcaagtaaacttggtccccaacccaccacaaagaggtgagaatttgactatagctgctgcaggtgtcctacaaaccactatcgaagaaggtgcatacatcgacatcgaagttagattaggttacatcaagttaatctcacaaacctacgatttgtgtgaacaattggaggagaacgacatcgacggattgaaatgtccaatcgaggaaggtgtctacgagttgaacaagatcgtggagatccctagcgaggtgccacctggcaaatactctgtcattgctagagcttacaacgtcgacgatgaacagatcacgtgcctaactggtgaagtaatcttcccagcgtactagacacacctgtcacaaaggctacctgtctctcactgaccttacccagtgtgagccaagtataaggtctcctcctatagcgacgttgcaaagctgtggagttctaggtccatgtacacgtgaccgaaccgattacggcacctttttacccgtcttgctatatataatattaattgaatcacaatttgaattggttgatctctctcctccgttaccccaggttaggaagaggtcctaatttgtattacatatatctagtataccctcctctatactatccctacctgtccagtcaacaaacgaccactgtcatctaataatgctaagaactgtcttcaacaaaccatcagtgttgaaatctggagttaactcgattacaaagcaatgccgttctcttcacgcaaatgcttacttgttgaacaagggcaacagcaacggtgctgagggccaagatgacgatgtcacggtgagaatcagaatcccacctatcaagagaaccggcgagtctctagacaagaagcgtgctagattaatttatcagtccagaaagagaggtattctggaaacagacttacttttgtcacgttttgctgctaagtatttaaaggaaatgaccccagaacaactagaagagtacgaccagttgttgaacgaactagattgggatatctactactgggccacagaaaactattccattacacctcttcctgacagatggaagaactccaatattctaaaacaattgcaagagttcagtaagaacaaggatcgtgaaatcctaagcatgcctgatctttccaaatactgaacatcagcggtatacgtacttgccaattaagcaacagtatagtctatagctcttattttatacccatatgctctctctccctctgtcgcggcagctcatcatttccagggcaggcccaagtgaaaaatttaacccgtacaccgcatacttagatccaacattggcgaaagtctcaaaaattttgttaagatcataaagaatgatatcgtttatatgatggaaaatatcataaatgtagtcgcgtagtccgttctagaggtcttgtaaggtcgtgttgcgaagggtacgtccaagatatcaagtgttcatatattaaagcatgtccagtaagactcctctttataaattaccacctcttcccagacttaaggtgaaaaagccaattattcaacaagaggctaacagatgcttggtattgatgtccaatctattacaatgctggtcttctaacggacacatgtacggtgcatgtgagacattggcccaagatttgaaggcatgtaccgcggaaaatgccttaggtaagaaccaaaaagtccagaagagtaatatcaactatcatgctgctagattgtacgatagagttggtggaaaatctcatgattagaaagaagcagacagactttctcccccttcgttatcacttgtacataataccattttctaatattacatatatcatctaaaatcaaggaattcacgatttattaaatatgatagagatttttgtagctatttgtgagtggattcatctcaaacttttctggcgagtctgccagctctttcccactcgtctttcgttagataccatcccggatggaactcagatgaatcatgctgtttgatggtattaaggtcattctcgttaatttcgttacaatgcatgttagaatctcctctgtaattgttttcaatttcccattggaaatcgctatgttcagtctcggcctttgtcatggagcctataggttctggtatccgtaggtatggatttctcaatgtgttgtttacactgcccaatgaagtgaatcccatctcatataatccgcatacttcttctcccgaatacaataggaaactccatatctgtgagagattccaatgtagcaacggttgcaacctgtagaactggggccaactggggtccgtcttttgaattggttgcaacgtctccccaaatggatctgtgtgtctaatgccgattactattgcctgagtctctggatgtaccgataagaacgacttgaaggcacttggcatatcgacctgtttatccttcgctgattcgtataacgataagtgatatcgctccacgctccgttgtaagaaatcttgtgccgtaagaaaggtatcctcttgatcaatgtatacagtgggtagttgctgcaacgggaacatgtggaactggagatcgtactgtgatccctgtattgacatgaggaaaaattcccatagacatcccagatatatgattagcaacacttgacaatccttgccaccgttgtatgaaaatgatatctcgccattgaacggatcccatctagtgaatatatcctgcagaaggtaccgtctactcagctgtatcgattcttgagtctgttttattacatctccggttgtggctacggcagattcggcatcgatcgataaatacgactgaacgatgttgtaacagttcagggcaacgtcttgcaacattgcagaaaacgtatctgtattatcggttcacactatctgatctttagcgaagtcctagacttctgcatttacggtaaattgaatcaaagtatattgtagttgtgtcaagaaggtttataaaacctcgaattgcctttgaacgattttcatcacataagccaagaagattgaaaagaggtacaaaacaaaaccattccgtttaccatccgaatgataccgctcgtgactttatgtattcaccatcagctacatttataggtgtattatctatattatcttaattatttacattgttagcttgttgtagttggtctggcaaatctgttttccttacctcatcaacgatcttttcaacgtcttgaggtatttcgtcaactggtctatgacattagcattctctgtacaccacaatacactagttttactcaactcctggtctgcctcaccgattccagcgttttcgctcacaatgacatccgttataaacctcacttgttcgcatatatcttccaaaatctctgtagtggcaatatcaccggtgataccgttggcatccatttcgtataccagttcctttaccatgaccaaatctttatattcttcccacataaacttaattagcaagttgtagaaatcgatgttgcatacgtcaaggtaaaggccgagatctttacaacttttgcatttattgtaaattgtctttaatataatatagtttctatctccaggtagtttgaactctccactatcaaatatgtaccgtatgatggcaggtaacgttattgaataaggttgtggtaaattggatggttcctcgcaagatctcttgtggatcacttcgatgaaccttttcgtttgaacctccatcttgggatccctttgcaagtattggtccaagtaatgcatgcaagtgtccaacaactctttatctgtggtcacagtcttctttaaatgattcaaatgtggggctagtgcgtgttccaatgctactctcaacttctctttttctgccactagttgaatggctttctctatgccggataatcgcacattttgataactggtcgccgatattggtaaatctcttatatcatgatcactaagcctgaaactggaatggggtagcggtgtctggctatcagaatctttatccgtctccattatccctgtccatgatggtgatttatcagagaagacgatctgtttattgaaaaacactggattcaataacctgttcatcgcctctttatccgggttctttttctgtttgatctcttctatcacctcagaaatggtattatgttcttcaatagcatctgcggtgctgctgacatgcttctgccccagtttacagctctgtgaaagtagtcttcttgtggctcttgttgttacattatggagatgagctttaaataaaagagatgagttcattctggcagcattcaacatatcgtaaaccacctctgtccttagattggctccttatacaagcttaaacgactggtatcaacactgtgagagacaatagattgaaccgtaggcatcttttgcaacgtcttttattaatcaaagccagtgtttccttctttgatttaagaatttttctttcaatacttattacatttggtatatattgattctttactgataacgttaatacaaaactgagaagagaaaaagcacaaaaaattcgtatcaaaacccatcaagggctttagtagctctttcaagtcttcttaaaccttcttggtacttttctggatccagaaccatatctgcagtcaatctagagagagaatcgaccaatctttcaagagctcttttctcttcgatcttcataccaaggttagagaattctgaccctatcagggttccctttgtaacattcaatagttgtgagatagtatctatatcgaaggatcttagttctttgttgtgtttggatccgatttttttggtttgattgtggctttggttttggccttgacgttggtgagatttggatctggtcttcgaatggcctttcttgggagcctttggcagcttactttgtggagtccttactgatgaggcagctttagtggaatcagcacctttctctactatgtcctcgtaatcatcatcatcttctggatcttttacattgcacactgcctggtcattcggttgttgtgtgatttggttctctggggtctccaatcttgacgatgatgagcttggaatagaaggtagtggcctagtagtgtatccatcctcctgtggtcccatggtatcatcttgctcagtagcagagaagaaactttcagatctcacactgctttgtcttgaatgtctctcactccggcttgcactggcactgtgacctttccccatctcctttgcaagttgattctgaatatcatctaaactttccttgataaatatatgtgacttgggccttcttgcgcttcttggtggtactgttggatgtaagtctgatatgatttcaagttctggttcagcaccagcggtcttcttactgttaacttgagtttctagtggtggtaatatactcgaagcaattgatttgatttcggatacctgagatatatcttgctggcttggagcctgtgatatgtttagtggtgtagtgtccgaaattgcttctgtgacattgaccttggggatgttattataatcagaaactggagtttgttgttgctcatcgtacgattcctctttaattgtcgtcgtttcaagttgagatagatgttgacagtcaccactgttaccagtagcaccatattgcgaggtatggtccaaatttaccatgctggatcccgaattacttgtggcagatgcgttataggaatgtccactttcgcttgctagattacctgatgcgattgatgaagggaccttctgatgggacatctccatagatacaagttttaatgagttgtttttctctaaagtaggagtcgtatctgtttcagctggttgcccaatctgttctttctttaacgaaacctgaggttcttccgtatcaatagagtttcctactggttttgttgttaattcagacaatgcatctgctgatgcagctgaccattcgctcttagtagggaagggcggtaaagctggctcttcaaaattctccttcttcacagcggtagtactgttatttttgactatataggagactggaacaccttcatggacagtgcctgaataagccgatattatgctttctctgtttcctggcgattgaccgtttaattgtaaacgattcccatctggagaaggctgaggggacccatacgtattgaagaatgccacattttgatcgttagatgtatatgacaattgtggagatgccctttcagcagaatctattcccttgcttggcatatatatttcatcatccaaactctcatgtaagctgtaattctcgatcatagcagaaagtctgttgtaattagggttgttgctagcgcttggtggcctaactgcactctccaatggctctttactcattgtatttgtccaagatagtgcttctggttgtagtatttcccttctttccagatcaactgttattgatacctgggatagtatcctctaaaatagacttgtttccaaagaattccctcaacaacaagcaatttcaaaaataaatgtatctacctcaataagtagatggttgttagttgctacaattactatactgggttgacaaacctctaacctgcgtttagatcaaagattcttacagtcagtaaggtgttgatgttttgatttcactgttgatctgaattccagatcaggaaagatagtaaacacttagtatttgaaggtcaggtgacaagaattgaagaaaatggaagtagacaataaataggtgtttacattagtaccgcaccttgatgcgcgtgtgtatacaatgatataaatgcatacgtattaaatagtgtttcgaacttagttcataatgtacattagttgctcttagggccaattcgtttcaattcatcttggaactttctgtaaacattaaaatcgaacttggcaaagttgtaatcgaggtctatgaaaacttttgatatttgacagctcttgtagtagtaattgaggaaattactggagtatgggtccactgatggaccatagaattctatcggaactggttcatggctgtaatgattatttttgaaatttttgtagaaggttgtgaacaaaccagtgacgatgggtgtatcatcctctacgtcggaatgctttttgggtccgccaaaagagcttgagttattgttgctgtcgttgttactgtttgtttcatggttcttgaaatgcgatgggaataacccttggaacatttcaaatgctgccaaggtgaaaccgaactgtggggaacttctcaacacacgagccggtccacctttgaaaaatgatttgatgctttcctctttcaagatcgttcttgctgcatggattacacctgtatacgttgtttctcccttcctgggatcgatttgtaatctggtcttaatcacatcaaaaggagtggtcaaataagctgctggcatacctgcgatcccaccagccaagaggagttcccaggttttgagtttgtttctcttgtttttatcatttggatcaaaattaaatacatccttctttaaatgagcatatgttgggaaatatatggcggagaatgggacgtctctcagtaagcatgctgcggcacctttgtagagaccgcgaaggcccaattgccttataattcctactgcacctaattgtggccttgcattttcaccgacgtaatctgatctcatttgtaatctgatctttacgatttccaatggatttgtaaacacaacttggcaagcaccagcggtggcgcctgaaaggatttcttggtaccatttaatcgtacgagacttgttcatgaaatactgtctcatgaaatcgttcactgtcaatttgatagctttttcgggggctacaccgattaactgtgggcctagaccagagtaaagacctctaatacccttagtttggaagattttcacaacacaatcaatggagtttttgtactgtacactgttacgttgcgcttgcattcttgtctttaccaggtcaatagggtacacgacagtggcgccgatgcacccagctatggagcctaacgtaaagttatgaatcgaatcaaagatcgggtagaaatagaagttagagtaccatgattccgatctaattctcttcaactccatggaatgcacaatatcgttcaaatagttagggttcaagattttcataaagtcttccatagtaaggttacgactctcggcagtatcctttggagtcttacttgcccaaagacgatccaataatgagactctttggctttgcttcctttcgttatgttcttgtaacgaagaagcctggctaaattcatccacagttgagttatagttttcgttgaactctttaatagtccccttattaatatgaggtcccatctgaacttggctatgaatgaaatcgtcgatggtttcatcagagtggtgcatcgaagtcaaacattggtgccttgactgttttgagtttgatacaatggagaacaagaggttaatctgtgatggggaaaactctacaatattcgtcactttgttatactctttattcaaaaactccataaagtccctcttcgtaatcacttgctctctgacatcgttctcatcgaattcgtaatattgtgcgtaacgtataagcacctggttcaaaagatcaaaattctcaaataaataaaatatgtcttttatgacattgtattggatataattgttatcgcatttgataagctttgtgttggataaatccaaagaattgaaaacatctgaagagactctgtgagaatagaacaatttcaaaaggtaagatagctggttcttggaaagcgtccgacaatttttcgatgggttcagatggcataatttattgaacccaacgaacattttctcatctttcaaatcgctttgcaaaatcgtgacgagcgaattcaaagagaaataagtgcctgaagatttcccaaacggactacactggtaaaatgggaaccaacgaaattcgttccaattcaaagccaaatcatttttcataataaattcatcgttaacgcatttttgtaagaacgaaatagtggacttaaactgatcgacgttcaaatacagctcatcaaaactcaggaacttattcccataattgatatatttcacacgttgatcatcgatattcgaagtttgtcgggcccgtatccttgccacatcaaacttcctgaaaaactcatataatacaatcaaatggtagttgttgaactccaagatgttgttgaaatggaaccaatcgttgatggttaaatatcctttattctgttcatccatggcgaaaaagatacatccaaatacattcttcgggatctgattcaaattgaacgagtgatcagtaaacttcgagtacaacgactgcgagttcgatataagcctgatgaaatcatcgtaccttaacaccgactcaccagtctctccggagtccgaaacatcgctagcatacggttctcccagctttttctgctcagcagtaagcacactggcatatttgctaaacacctccagctgctgcttctttttctcgctattcgaattcactagttccatctttgcatgttgttatatgtctttaatactttttgccttgcttctatttctgtgtctctctttaaatcatataataaataataacgtaaacgtaaaatgccttaacgaatgataaaatgcattcaaatcttgacttcttgacaatgtaacgaatgttcaacccagataactaaaagatatgcacaaacgaaattattcaaagtatgaaatatcaccttgtctcacagcttcatttaatgctggacggatcagagagatgcttctaaaataaataaaatgtgcctgtttccaaaacagttttggcagcgaaatctaacttcccaactgttggctgaacgatacaggattaaatacgaactaaacaacgttaatgtaatgatgttaaatccagtttccaatctcgtgttggccatctctaacagcttctttgtatttgaaccgattcaaagctgtgatctttttttgggcaaaaagatttttccgggccctcgaaaacggagtttctggtggaatttcggctccgattctttcaatgtgcttacgttaccccagaaacattgttttagggacccaaattcggatttctggcccgctcgggccgcagggtctttccaatggagattggagcttggacatcaggtcatgtgacctgaaagtgttttacctatatttcatggtaagcagcaagtttgcatgtccagatgtgtgtattatttgtatttataaagtctgcgttatagaatgtctgactgttctgtttgttttcgttgtttttacaagatggcacgacgactgatcaagtctcgtacatgtgttcgcatacagctttttctctaccgatggatctttccaggcagttgtcgaataaattactgaattctctacccaattcccaataacatccatggaacatgtctctcatgaatagcatcattccggcgagatggtttgtgtttgggatgtttcttagtagccttgccttttctttcagttgttggtggtgtgtgaatacgtcgagattttctttaacttttaagtacctgtacattttcttcagatgttgttggaaggtttctatggggacatattccgatttcaccttcatgttcatctttaatgatgcatcaggggagttgtcccaaatatgggtttctgggccgtatagagagtaattgtaagaccaaattaagagtgtggtcaatgccaaggtgtttggtctagtgatacaatagtcgagattcacgtcacatgacatatcttctccgttgtggaacatctcgaataagaacatataagcataaataatggccattccaccttgcatcgggtcttgactgaattttaggattctttcgctcaccaatgcatattcttcagtgccagcacgaacgttcattctccaaggtgcgcctacatatatgtaatagtcgtattggaatattcttagtataatttgggtcatgtggtaggctggaatcttacacgagcgaacgtcatctagcctcaacagtttgattccttcgtcgtccaccgcatctatgtgggacaggactgagtttgatgaattgttacaaccgtgcatgacttcttgatgccagtaatcgatggcgaatgaaatgatctcctgccaatgtatattttgtacgcttaatgggttgtcggcaccaagtgaaatcacttccgaatgttgttgcaattggaacatgatagatatcaacccagatagtagcaatttattgccaaatttgctcgttttcaacttggtccaactgtttgtgttattcgatctttgcaactgatgcatcacatggttcaaaagctctttcaacgcgtcaaggaagcttatatccttgcttccaaatccatgttgcaataatttgtcgagcgataaatcgtagctgtcccaaatctcgtccgaacatggcaacgaaatcctcacttgattacagtgaataaataggtatgtgtatccgaacacaactgcgtgagttgtgtcaatgtaaaaggcgtataatgctgttcttttcaaagtctcaaaatcgatccaatttttgtatatcacttccattgattcgtaattcgatggtgattgttccttcttgacacgtaacggatgccctcccaaggaaggagttctacgaagtaattgaattgtggtaccatgatgcaaataacttctttcatgcaaatatctatttgtactggtcttttcataacactcaagcaataaaagtgactgaataatataagtctccgatggtggttggaaatcttcatgcgaaaatatcaaccaacgtaatggtcctgcaataacatcacttatcgtacgacgagtggcagatcccagataggaagcaccggtcataatcatactaagaataagaattggaggctctttctcaatgtcaaatgacggtttatgcaaaattggatattgtggatggaaattcaaccagtatgacttcaatgcagtttgtaatttgtttaacataatatatttcacgtccgcgattagcagtgctaatgtaccttgtctttccaacgatagtttgaacttcgagttagggtctatattgaaaaatgacggcctggatatcagcttagacctctgcttttttgatagtctgtgagaatccgattcaacggtagaaactgttgctgaccgtttcagttgcgattttaactctccgactttcgacttctgtgccagtaaattgtccttaatgttctcctttccaacatctttaaattttggagatctatttggaaccgagtcgatggatgaagtaacagagcctgcattagatggggtagcgacactttctcccgattgttgagggatgatatcattgtaagacatctgctgcaccaaggtttgtaacggatctgttggtaagaaatccaccgagaataaatcatccacgatatttgttaatcctggattggtattgaggcctgtgttaagttcaggatcataactctgttgttgaggcggaaccatgtgtgctttttggtccaagggaatattatcaatatgctgctgctgacgttggtactgtggctgaacgtgggattgtgacagaggcggtcacaaaattgatggatcttccaacttcgcagttggtggcactgcatcagatggctgatccaacctactattctgttgaggcgtagcatcctgagttacaccaccggcgaacaaccagttgaagaaactgttcaagttaccgtttgatgctggccccattgcgttaaacccagcattcagactagtattactactacttgtcgtactactgctattgggcaaagagttactgtcatggccaaccgcatgtccgctacccgagctcgccttattgtgctttttatcccccacatcaagtacgatatgatccacctttttctgctgttgtggctgctgtccaacaccagcgacactcgccgtatccggcagctgcggtgccgctgctttagacccacccgccgctctttctttgccagattctcttctcaccttcatctgcattcgaacaccgttattcgtgtgacgtctctgatgtctcaccaacaaatccttccgaacgaaagtccggttgcaaactatcccatcgtcaggataaacatattcacaccgaaatatctgcttcggccagtggttaagcttatgcctctgtaaatgctcataccgtgagaaggtcttctcacaatctggatgaggacaaacgtatctgccgcctactttttcctccgacgcttccttactctcagaacccatcattttctaccaccgtctgctgtacagcgtaaatatatcaatagatactgaagtacactgcttactccgaggctccgacagctgatgatttaaggataacgaacagtatatttatgatgtcttgtgattgttatgctatgatgagtacggtcgaatcgaaactgtttttcagatgttgatcgcttataatcacggcccggaaataatatttctggggtccccgaaaaaagggttttgggggatatatatatatataacggtgtatgtggtggggtctggagatgtggtagagatatattacatgcttagtgcgaccccctcgtattgggaggacgtgtttatgtagggatctactgggaagtttttcctcgcgatgtttatggcgatccattcgagtaaaatgtcgcactgtttcactaggatcttggcagtttggtcatcgacgttgcttgattccatcatttcggggagtaaagtgactagtcttagtagatggataattccgtaaatttcagtgtactgtttctccgagtgtgctttcagtagttctgcatattggattctttctagacggtacaagagtaatttccccagggataagttgaagtagagttttattccctgcagaaattctgagagttgagcttgttctaccactgaggaggtcgaattgctagtatctgcatagaactgggacaagatatgttcgattggccgttcgctgggtagttgtactagctttctgtcttttgtgacgttttcccagtcgtctacaagcacagaacgaagcgagatagggacttttatgtgtatcttagggtgtgatcttttgtttagtactggggttgccttcttacggtcggatttgtcagagctggaagctgctgctgttgtaccagaagatgaagatgaggctggattagaagcggaagtcgaacttgccgaagtattagtaccactgccactatttgaggtacggctggccgcctttttgcccttctcaaccttactaggcctgccaacaggccgtgatcctgatttcttcttcccaccattgttcttcaactctcgagccttttccaccaacgacttcttcaattccaaattctcatcgttatacggtctgattcggtctaaaccaacccattcgtcccaactcgacttccagccctggtaatgcacaaaatagcattggccctgtctcatatgttccggcggacgatcaaattctactttttcatcgtcaatactcacgtctttgtagtcctttgatgtaatagtctgattcttttcatcgtaaactcgtaatactttggcttcatagagcaaaggtccgtgataacacaaacatttcccatctagaacaattgccatgatcaacagctactgaaagttcccctgggacaattaaattttggagaaagaccagcgtagcaggttcaaatactatgtgtaacttctgtttcgtgaaagtgctagatggtagctttaacgtaagatttggcatttgaattttacgtgaagaaacatgggaaaacggacagtatagaaacagtagataacactaggtgagcacttgatagtaatggtatataaaccgcagctacttggaaggaatgcagtactttccaagaagaaggaagtgggaaattctgatcacgtgacaactcacgtgatatgatatgacattggaagtgacctgatatctccaagtattgcctcaaagcactagagtcaaactagtatcaattcataaagtcttggccacccttcaacaccaattccagcaccacaacgccactaatcacgtcgcatatccacctcttaccatcacacaaggtctgcaaagctctcctaataatgctgttctgacctttaatgccaaagtaaagaaaaaaaaaagttgatgaaacaaaaacaaatttgaaagaaacagccttttatcacagtgaccaaagaagcaaaccacaacggttctgactggcaaggacgatcttttacacgcggacaaacatctgtattggtattctgagtcgatgagacgttatttgagtggtggctactgaactattttattcgaagcaagagagaaaggaaaggtttcccacatttcctagtattgtatttttttgtttcccgataggacttgataaaacccagagtcggtgcttttgcaatgtctaaacgttcgtcccagcatgtggtaggaattcactatgctgttggtcctaagattggggaaggttcgtttggaataatctttgaaggtgaaaacattctaaatggtgggtcgaagaaccctgttgctataaagtttgaacccagacggtctgactcaccacagttacgggatgagtttcgcgcatataggatattgaatgatgtgagaggaattcctcatgcgtattatttcagtcaagaggggattcataacattttgatcatcgatttgttgggtccgtcgttagaagatttatttgaatggtgtagtcgaaaattttccgtaaagacgacagcaatgttggcgaaacagatgattgatagagtacgttctattcacgagcatgatttgatatatcgggacattaagccggataactttttgatatctgagtttcaacgggagttatcggatgggtcagtggttaagtcgtgtgccacaagcagtggtggtgacgcaaacctaatatacgtggttgatttcggaatggcaaagcagtttagggacccaaacacaaaacaacatataccatatagagagcgtaaatctttgagcgggactgcgcggtacatgtcgataaacacccatttcggtagagagcaatcgagaagagatgacttggagtcccttggccacgtattcttctatttcttacgtgggtccttaccatggcaaggtttgaaagctcttaacaacaaggctaagtatgaaaagattggactcacgaaacagaggttaaaaccaacggatttattgacaccggagataccaaaacagtttgctgaatatctatcgtactgtagatcgttaaggttcgatcaggacccagattatgattatttgatctccttgatgacgcaaatcatgcaagaaaatgggtacgaagaagatggtcattacgattggatggatttgaacggcggtcaaggttggaacattaaggtcaacaaaagagttaatttgcatgggtatggtaatccaacaccaagaaatacaaaacattctgctcaacagcttacaccattgcatcaacagcaggcacaacagcaggcaccggggcaagtacagggacaaaatcatcaacaacagaatagtaggcacgattcacgtaactataggtctttctcacaaagcacaccaaataagtctcaaaagaaaaatgttaatagcagtatggggaacagtagggtgagattgtcacagggcaatggatttgtgggaccaaacgtaccattgaaacagaacctcaatatacaatcgtacgattcaatgggtaagcttcatggcagacgcattccgaataacgaagagtatgacgataatgattccattgaagaaggcggatttttttcaaaattgtgctgtggaatttgctagcccattttttaggcccatgacgagaagatgtattataagttaatttaaccctccttacctatttgttgtcctgttgtaagagctgaaaaggcgttgatcgtctgggttctccaataacaggcacacacggatacatttaacgctgagcgttttgcttttataattttttttccaaggcaagaaggaacctttcatatctttgtgtctctcccattcccatgatctttctcgctcggttcgcatttattagacaaacttacacccttgctttagctgaggagaactgacaaattacatgaacatccagatatgtaaatagaaatacatattcataatattttactttactttaatataaattgtaatttagtttcaaggaacttaaataacgaattaagcacttgaagagtatatttaatcattgaattatttattagctgatagtaagttaaatttgaagtgaatgcaatgcaatataatttccacatgggtaacaggtttcaatgaattgcagaaggtgattgagggaggtgaacgggtatcataagccttcgcatacaaatgtggcatcgctgcctcttctaatgccagacagaagagggattgtgggtatatcgaatgaatgggttttaccgtcaaacatgctatctagtgcaggcgtcattggagaatgggcttcgtattccagagtatcctcagaatcttcaaacgcagaattgctactatccttggttgtttcatctgaactggagtagaccatagtagctggaggttctgatttcgtttcggtcgacacggattcgagtagacgtaatgggttccttggtggaggtaaaaccattggcatgtcaacaaccgagtacgatcttagctcttgatcttgcaaggatatgaaatgagagtctgctaagccgacgaaatgactccctagatgtttcttgtttccgattctttccagatctggagattgaataatgttaccgttttgcacacagtccgctggtaatccaaagctctggataccatgagatggtctgcaacacattacttggtcggtgaatttcaaatctttgatatcccaggacattattaagccttgatcgtctgtactatatattttcttcatttcattatcgtaatcgagactgttgacatgtccgttatgacccaacaggtgtgctctaaccttcccatatctgatatcccatatcttcaatgcctttccgaccgaattaacgaccgtatattcatctaaccatttggaagtataacatttgccagactcggcattgctgtcctgaggtccagggacacgtattccgttaccatcacccaaacgaagatccaacaatgcaattccggactgcccaaatttcgttcctgtcagagaaaatgtgaatggattgactgggttaacatcaacgtgttccaaaccggggaaactgttcaagtataatgggtctttgcactgttggttcacgtcatagacaaacaacgaatcgttaatgacagaggtgaaatgatgcttgttccaggtcttcaaatgacgaattggttttgaacgacttgtgttataaatttgcgtagcaagatcaacactatccatgctatcggtgatcactttcaaatgtttggaatgattgaaacgtcttagaattttggcgttcccattctcgattgaagttgcaattaagttcacatatccatcagagtgtcctgaaagtaagattctgtcatggactttatcatcgaaggaaactacggtgtcattattctgcgattgcatgatatctgtagccagaatagattttcctggaacagtaatggtttgtaaactatggagcaatttcccaccgcgagcctgctcattaatttcattattccgcaattggaacaactgtaaattatccgatgtctgtgatgtggaaagtagaatggtgtccctatccaatgacattgaagtgacgtccctagtgtcttctgacagtttccaacaatctgtcttcaattttttcgtgacaatgacatcgttcaaatcaccactaaccttccttagcaaggaactgttcaatttcgaagcctctatcttgcaattccgcctgacaatagtactgttctcgtcatcgctaatatctcttctactcttcttgacgatgatggcgttctgtctgaatatctctggagccctgtagaattcagtcataattttcgcaatatacagtttcttatttgactttgtgtaatgtttgcactgcagagaataattgattgttaacaggtacatccattagaggagtaagagctggtcacttttagaaacgacatgtttatatatgatacagggcaaataaaaatagcactagcaaacactgagccaatcaaaaataggaccaaacgcagaacaagcaacaaaaattagagaaaggcacgttacctattgagtgtgttaggcagccatatgagcaaacatcctgtttatgtttgcaagaggtttgtttacctgtaaacaaacccagcatctttaaagctggcaaaggcttgtttatatttatgtcattttggacgatatgatttttgtcacgtgatgcccataatcgtcccatatgcacgtcatctgacagcaatacggcagattcttgcaacctggtggctaccaccgccattaatgccgtttccgaatttactgacatactcggcgtagcctggtatccctctttagtactctttttccaggtttcaatctcctcacgtgacaagtaaaggagaaaagaaaattgtgatttgcatattttaattaaggaaacaaaacaagaacaaagatactttacttgcaaacaacatccgatttaatcatcagatcaaggtgctagaggataagcaaacgtgcattgacagtggcaaaaaggacggtacggaaaagggtattgagcaaggtattgatctgatttttctttgcttctttttagaggaatcatcaactttttttctggttctgtttcctgttctgtttctttgcaattacgacaattaaagaagacaaaagacaaaaaataaaaccttataggctttctcgggcggttttatttgtttaataattattgctgttactaccacttatcagatatctagtgtttgaagacttttcaatttgttattgagattccactttgaaggagaaattatcggatttgaaattgacaaaccattaaaaaaataaaaagctgcgaaatatgtctatctctgtgaaactagtggctgctgagtcattgaacaggagggatgtgtttagatctcctgatccgtttgcagttttgactatcgatggttctcagacgaaatccacagcggctgcaaagaagacgttgaatccctactggaatgaagtatttcaattcaaaaatgtgagtgaaaattcgatcttaactgttcaagtgtttgatcagaaaaagttcaagaagaaagatcaagggttcctaggtgttgtcaacgttcgtattggtgacattctgggtcacttggacgaagatactgccacttcgaacggtagagctcgtgaagagactattactagagatttaaaacgttctaacgacgggttgtcagtaagtggtagaataatattggttttgacggttctccccagagctggcagccgtaatggagctgctggtgccgcaggtagtgctgttgctggttccggagcagctcgtcaatcggattcgatgacgaacgcttccactatcgacaacagattgattgctcagactgttgctaacaacttgcaaactactacattagacaaccaggattctgcgaatgctgcaggtaccgccagttcaggttcaggtgccggttcaagtgatgctgctccatccggtcaaccttcgacagctcaatctcaatcgtcagctagcaggcaatactcatcgtttgaagatcaatatggtcgtttacccccaggatgggaaagaagaacggataactttggaagaacatattatgtggatcataatacaaggacaacaacatggaaaagacccactttggatcaatccgaggttcaacgtgtcaacaccgaactagaacgtagacaacacagaggaagaactttacctgatggtggtgctcaatcagagggctcgtcttcatcaaacgttgctgttcataccggtactggatctcaaactcctgccgtaaacggttcagcagctgctacttttgctgccactgggggtaccacatcggggttgggtgaacttccaccaggttgggaacaacggttcactcctgaaggaagagcgtacttcgttgatcacaacacaagaaccacgacatgggtcgatccaagaagacaacaatatattagaacctatgggccttccacaaataccatacaacaacaacctgtatctcagttaggacctttgccttctggttgggagatgagattgacaaacacagcccgtgtatacttcgttgaccataacactaagaccaccacttgggatgatcctagattaccttcttccttggatcaaaacgttccacagtataagcgtgacttcagacgtaaggttatttacttcagatcccaaccggctttaagaattctaccaggtcaatgtcacatcagagtacgcagaaagaatatcttcgaagattcttaccaagaaataatgagacaaacgccagaagacttaaagaagagactaatgatcaaatttgacggtgaagaaggtttagattatggtggtgtttcaagagaattcttctttttactatcacacgagatgtttaatcccttctactgtctatttgaatattctgcccatgataactatactatccaaatcaatccaaacagtggtatcaaccctgagcatttgaactacttcaagttcattggtagagtcgtcggtttaggtgtattccatagaaggttcttggatgcattcttcgttggtgctctatataagatgatgctaagaaagaaggtagtattacaagatatggaaggtgtcgattcagaagtctacaactccttgaaatggattttagaaaatagcatagatggcattttagatctaacatttaatgttgatgatgaaagatttggtgaactggttgtcgtcgatttgaaaccaaacggcagagaaatcgaagtcacagatgaaaacaagaaagaatatgttgaactatatacccaatggaggatcgcagacagagttcaagaacaatttaaggcatttatggatggatttaacgaattggttcctgaagatctagtcaacgtgtttgatgaacgtgaacttgaattattgattggtggtattgcagaaattgatgttgaagactggaaaaaacacacagattatcgtggataccaagagtctgacgaagttatccagtggttctggaaatgtatcactgaatgggacaacgagcaaagagcacgtttgttacaattcacaactggtacatcgcgtatcccggtcaatggattcaaagatttgcaaggttctgatggtccaagaagattcactatcgaaaaagcaggtgaagttcaacaactacccaagtcacacacttgtttcaacagagtggatcttccaccatacactgattatgaatctttcaagcagaagctaacattagcagtggaagaaaccatcggatttggacaagagtagttgaatgaatctttcaatcttttcaataccctgcaccttctcaattattcaatcagaaagcgcaagcacaaacacaagcacagacatatatatgttatagatatattgttgccaaaacatgtgtatattattacatagaaatttttttcttaacctcgttaggcctcaacttatggtgctttgttatattttattgccattatcaggtgttactttatataggtatgctataatgtgggaagcaattgacaacgaagtatctggttcctaaccgacggagttttgtaattgcccagagattgatatatccagcttaaattttgggataataacgaaaattagctgcatggagttgatagtattaagaccgggttcttaaatgaaaagggttaagttgtaattatatatatgataattatgatagaggacagggtaaagcttataataaaataatttaaatgagtgaattgaatgaatttattgtatattgtataataacgagcgacaacaatatatttgaatgcaataataatgaaaaaagatgttaacccataaacgtttcggtggcttaatgttgtagtttttttttaaaagttgtggcttaattgttacggatctttcatgaatcggcctatttcctctcactatgaccctttttttgacctggtatgtaagtgaagagagtgtaatcacaatctttgattgaatgtaaagattgattctacaccgaaagatcccacaattaataccttggtattctatttttttttcctttttagtgcagtttaaaaatgcttaataaaacaacctgttaccattcagaatgacattcataagtcgtgacctatttcccctgtgtataaaataaattttgtatttccatagaatcgactatccatcagataaagacaaaaaaaatgaaaaatctaaaggaaaagtaagattgatggtagaatcaaaaacttgtaacaaatatttcatcatgaattcggaaatgttttaaacaatttgatgactgcatgcatccttctcgcttctttcttctgtggtattttttttttagtttataattgtgttttacgctgttgcgacttttactagtttttacaaggttcctctcctttaattgaaatatgtggaattgtcaccaaacattggaaagctgacatttctgttatgctgcattatattggaggaggagcgtgggggcatcccgtttggaggggtattcgattgtgaatccgacattggaaccatattagatccattgagaattcccggtaaagatacaaatgatgattgggacatattggaagtcaaccctggttgacttggagttgggaacccatacatcatagagctatttgattgtggtgttgggtattgtgagtccatgtacatcggagctggcatgttagcaacattatttgaggagaaatgcaaattggagttcattaataatggttgctgcatgctttgattgttcaaatactgatcaagatgaggttgttgatgttccggtgccggtggttgcaactgttgaaatggcggtggctgttgtgtttgcattgaataatcatgttgagaagccattggcatctgcggaacattctgttgataaggtgggagtgtcatctgttgttgaatgctgtttttcttcttgtggtgatggttgctgctattatcaccgccggtgtttatattattgtggaagttagtgtttctttggaattgatggttattggtattattgttacctggaccattgttcctgttgttcagatatgcattggaaggcagagaaaagttgcgagaatggtgcttgttttgttgacggaatggttcattaacctttttctttgttggagttacatcatcaaatgtgattcctgtaagttccgtgtatgctcttaccttcaatttgatcttcttcgcgtatgatgtgtttttgatacttggcaacagctccttggtgattacaatgaggttactgatcttggcagtgaactcatgactgaaacttgctagccgaggattattgtacacaatgttatttcttggatgttctagaatagctgaatagtttctgacgtccaaaagagtttgcaatgcgtagttaccatagttgtctcttatcaaagaagtaatgttagccatgaagatatcagcaattaccaaaagaatacccatggaagcgttaacaacatcatccccatcatcgactctgtcatgtggattcaaagccgctgttgatgtagatgtagttgctgtgttggacacataattcatcacaatggcaaacaacttctttatatatttctcaacaacgtttgaagaaaactttaaacaggacaactggcacaacttttgtgacaatttgttgaaagtttcgcctaacaggtagaaatccaactccttgatatcgaacaagaactggataatatagttaccgaattggtcgttgatcaaggagggcaagtactgaattatcttgacagaaatcttgaaaatctgttgcagagtacaaacactcaacaatttttgcagtacacaacacccgtgtttgtgagttgagatggtaatgatgttatcgttattgacaatggcgtcaatgataaaatcaaaatttgctggttggaatttgaagatacatttctgaatgacatgattaccgttcaaatcattaatcaaagtgactacctgttcaattgatgtatgctcctgagaaaatcccctaatgatcatatctatatgttcttgggtctcaacggtatcaatgatcttttgcaaggatctggtaccatattgattgatggagatttggaatacagagggatagatatctttaatcattgcggttttctgatcagttgtcaaataatcacatagcttttgaatcaaatagttaccgaatggatccaaaattagatccaagaagaaattgttgacattctcgaagattaaatctctcacttgatccgattcttgaggagtttccaactttcgttgcaagaatctacaaccgtattggtctgtagacaatttcacgtaatccaagtccttcaatcggatattatgcaaatcgttcatggaagtcactgcagaagttgtcgcagtagatgatgacgctgatgaagacgatgctgatgatgcgttcgatccagtattaccaccacttgacgacactgtattcccgcgtgcgccagtcccacgagatgtactagtggaaccatttggtgaagaagcagttgaagtcaatgacgttaaatcagcagctgcagaacctcccggaggtaagatggattcgaattcattgatcaagggcaacgatttcatacgatttttcgcattggcagaactagacgcagccgttgacacggatgtcgtggcagaaatcgtactcagcggtgacattgtattgacattcagaggagaagtgttggaaatgaattggttgaatccagacaaatccaaagaatgtgttctttgatggttattcttagagttcatctggcccaacggcggagtcactggctcaatgacagattgaacagagttaactgacagttggggttgatgatggaattgcattatccactagttatgtctcgactccggcttcccctaaatacttgaatctttgattctattataagatcttcttcaggaaagaatagctttcaaaggttaatcaccagacgaaaacagggacttggagagaaaaaaaaaaaagcacagtttagtctaaacacaatctgttagtatctcagctgaatagtatcctcttgttccctctactcttttctttgaatgaaaccaaatttagttcgcagctgatctggtaccagatctggaagcaaacaaatataaaacaagcgaaagtataaaaagcccacaaatcagaaactgatcttttgtctagcgtaccctaaaactcataggtctgttgtatacaccaggaaaacctcaaacaattgttccagtaacacgctcttcttacaatgcaaactctctgtgattcttgattctctctattcttatacgattctgattcttccatactattcgagggataatgaaaaataatactcaagaaatacgtagacgcccgcgtaggaaatatctgctttcctattgccctgcctagccagaccgggggcgccgcccgcggtctaggcagatcagatgagcgtagacaggaatttgagaaaaatgattcagggaaaaccagggttgctcacgtgccggacaatctgtctggacagacatttttcacgatcgaaatagctgttaggcagagaagtccaccgtggccaggattattgtccggcacttctaaatcaggacgagaatgtgaatcaaaaagagggttggattgagcgaagaggctggatcaaaggtactgtagtcacctgcaacagttctaatatgagaatctgtatagtgctactttcagtatcactataacagtaatttaaacgagactcaagttggatcattaattggcaaaagctttctgtagatgcagaacagggggaaagaaggtaaaggttaatgggtaaaggggctgtccgttaggacaaatttcaatacatactggtggggtttggaaaaagcactgattgcttacggatcagtttctgtggtgaaaactagaacgtagatccagaaatcaatttgatctggggaactacttcgtttccagtgggatcaatgatgttcttttcctgaacaacgtcgacgctagtatctgtatatggaccagtgctagaatctgacctaataagtgctgttttgaaggtaagtttgtgtatatcaagcgcaaagaatgtgtatgtataatactgaatatatatatatatatagataaaattatttggtatgatttggtagggtagtaccctactttattgtgaaacaataaagatgaatacttagggtaacctgagggtccagaaggtcaattgacacgacgtgtgagtagcaattagttcaatgcattggaatagctggtatctcaacggcagcgaggcatgaaattgtcagtctcattggctataattcagtatttaacgctaaatatatgattaaataatgatgatttagccagtactttctaataagggaactcagttctaaaatgaaatagtaatatacaataacgtagcggagtggggggtgatgcaatagggaataattgagatgagtaggaattttggtagtaataggttgtacttgttcttacacaagtagcacagcgttgacacaaccgtctctatctggctcattcgtgatttgagcatatttaccccaaaccactttaccaccagaagtaaccatacctaattccgagacgttcacttcaataatagtacccttggttaatacacccaactgtgtgtacattggcgattgaggattcttcttcaccgcaagaattggcaagaaaacggtgactccaagttccggatgcgtcacattagccttcttttgtctcaaagcactaggtctgataatcctttccatcttcacaggccttcttgtaaacccttcaccaacaaacgtatgtttcgtgatcattctcttccatgccttagacttagacttacctgtcttaacaactttgaacatctcttcctcactgatacctctgaccttaggcaaaggaacagaaaacttgtcagccttctccaaacgcttctgcttgatggaactggatatagcctttgcagtgttgttctgttctctgtctaacaaataagtaggcaaagcctccccgttctcatccaacggtttggaccctcctttaactttactctgctcatgagcacggatcttcttcttcatagcaaccttctcagcataacgcttcttagcaaattgcttacccttccaaccagtcaatttctgagccttttcagagatcttatgagcctcacgggcttctctcttacgttttctctcatcgtggtctaatctacgaccatgttgcttgatgtgctgttcgatatattcgttttgaggcatctttgttttattgtaagaacgacttgttcggtgatgacttacttctaaatcacaaacggacacacggactccttgaatggacttcttaccacatgttaacccatgcgatgagctagttgttcaagttgtctttgtatgcttttctcattgaaagaaaaaaattcaataggaaatgtcgaaaagaaacgtagtgaaaaaaaaaatttggaatcaagcgatgagatgagatgagatgggtatcagccagatacaagtttggttgtctggtgtgggtttggcataggttcgatctactgttattgatgtataaaacctcattacattctattgacaagggttacagcggaaatatagccatgtctgaggagttaggaactgttttgaaaacgattagagattctttgaaatcttgtggagaaagcttggataagttagaagaagtctatgatgatgaggagacccatcctttccaaggttcagcggtggtaggtcacaaaggtgataaattagaaaaagtttctctactttctttgaagaatgggagtatgctatcgtatttgaattcgcttctgttggtattgggacagaaattgaataaagagatggttgttgatgagggtagagtcagggcagtggaacaacgagttgttcttgaaagaggtgtgaagcccttggagaagaagttagggtaccagctggataaattgacgcgggcgtacattagactggagaaagacgttgaagaatccaagaaaagagccgaattgcagggactgagtgacgtacgtgcttcccaggaagaagtatcagactcagattctgatagtgaagaagagatgcaatataggccgaacagttcaggaatggtcaataacacatcagttggagggaaagccaaggggaaaatcgctgtcaagagtactcacaatgaagaagatgtggatgataaagataacgtttatagaccacctaagatcagtgccgttctgccaccaaagcaacatcacttcgaggataaattcaacgcacaagaacataaggataagagtagcaggtctcgtatgcaagctatggaagaatacttgaaggattcctcggaacaaccggaatgggaaacttctatcggtgccaatatcgtcaaccatggtagaggtggtgtgaagacagcaagagatacagaacgtgaacgtgatgttcaaagattcgaagaagaaaatttcactagattgaaccccaacggatccaagactgacaagagaatgaaaaaacaaagagaaatcatggccaaggttaatatgatcgccggtgaagatttcagtatcttcaactccaagcgtaagttggaggatagtacaagcagaagaggtaataagaaatctagaaatgcttgggaaagagccaagaagaagttgtaaacctgaggtccttctttttctatgtataaataggctaaaatatccatacgtctctattgtcatcatatagtgtcaaatacgtagtttataaatcgaatgataacggtgttgcactgctcaaactctagctttgatgtggtttgtttcgtttcgttttgtctcgttttcttcatatcaaggtgtaatcaccaataattaattaatacaatctaagcgttccaactttgcaagatataatcaccacctatcacccctactaatctcctaccagcgtacaacttccagcgcccctgatgaagaacgaatacaccagaaagaaagtctcagcaaaggataggaaagcatgtctgatatgtggtaaccctacagtcacagttttgttcaatggaagcggacctgattggttttatacatgcgatatacatctagttgataacccgcagtttgtacagcctctatacccaaaagagtatcacgagtctctggttagtcttaagccactcaaagaacgcatagaggagctacaaaggaaagagcgaggtacctgggatcaatgggttaataagatctttgactctaaaaagccatcatcatctgatgataagaaagaggacagggatgacgcgagttctgacgacaagaagaagaccgatgaagcaaactcacttgaagaattgcagcaaacgtaccaagcgacacttgataagctagctgcatcaagagagacgtgcaatagatacactctacacgacctagtattccaatcaagagtcgacagactacggaaactggctcaattaaaggaaaagaaacgtgtagagcaacaatcatacaccaacaccgaccccaatcaactattacaatcgttttcgtttcctgaagtccccaagaacaccgttaacaagtcatgagaggacggcctaatatgcctacctcttatgtcttttgtgcaattctatatcacgtgattgatatcacgtcaaaaagaaatttctgatcttttcaacttttcaatgaaaagctttaaagaagcaggacatagttagatcccatgcgatgagcttcaaactagaacagaatacttgctggtttcaggcgtttcatctctggtttttgctattttaaataattttgaactttaattcgatacgtgctctaaaaaaaggctaggaactgtaatatcatggctagagtaagaggtagaaagctaataaaaaagctcaagaaagatgagttccatccagaagacaataaaacccatgatgagcctacggttagccatgttaatgaaactgctgggggtgacaatagtgatgtgagtcctaatactttctttggtgtcctagattctggcgaattggattattttaagaaggctgaatccacgttggctattgatacatttgagaatccagatgagaagtaccagtttatcaacagtgtcatcgaggaaagtaagggtaaagagttgaaacttgctacgtctcagatttcttctaagctaatggaacgtattattatggaaagtgatgaaactcaattgaagactatcttcaaagctttcaatgggttttatttcaaccttgcatgtcacaaatattcctcccatgttttagagactctattagtcagaggtgcagcacaggtggaaaaagaattgttaacacctgattttgattctgttgatgagggtgaattcgttactactgaatcattgtttttgtttttgactaacgagttgcaaccgaacttaaggttcatggtgagccatcaatatgcatcacatgtccttagaattttaatcttagtgctatcgtcaaagactttaccaagtactgtacagaacaattcaacattacgttccaagaagtctaagattgcacgtaagatgattgacattaaggataacgataactataacaaaatattcaagactcccgattcattcaaagttgttcttcgttctatgttatcttcaatctacactagtttcacacatggtattccacagggctctggacacttttctgagatttctctcgctgacgttatgaaattcagggaaatatgtgttgataagatcgggtctccagtgattcaattggtaatacaagtagaaggtatcttcgatagagacaggtcatactggcatctaatattcaaagattctgatgagaaggatcccaaggaagagtcatttgtggagtacttactatcagatgctgttggatctcatttcttgcagaatgttattgcatcaactagaatcaagtacgtggaaagattatacagattatacatgaaggatagaattccaaaacttgctaaaagagatacaactgctgcatttgtgttgcaatcacttttgaaagtcttgaactctaaggaagtcaaagagattatggatgaactggtcccagacttgagcgttttgttgaactctaacatggatttcggtactgaaattatagatgccagtatccgtcatgataattatttgagggacgaaatcattgaacaattaatgaagaaatactatcctcgtgagtcatctgataagaacatcttagaatcttgtcttcagttaagttcctctacccttggtaacactagagatgactggccaactgctgaagagaggagaaaatctctattcttagagaagttgattgattacgatgattgcttcctaaacagtaccattgacagtatgttgaatcttccagcagaaagacttttgcagatgccataccatggtgtgttttctcacgttgttgaacatgttctacaggttaaaagagttgccatcatcaaaagaaaactcttactcaatgtgttatgcaaagatatcgtaaacttatcctgtaacgcatatggttcccacattgttgataaactatggacatttacggctaaattggctatgtacaaggaacgtatagcaactgcgttatgtgcagactctgaaaaggtcaagaacagtgtttacggtagacaagtgtggaagaattggtcgcttgaactatttgtaagaaagagatacgactggaaaaaaatagtaaaagaacaagagctcgaaatgttcccagattctaaacctttacaaccaaagaccttcaagcgtcctaataataacaacaattcggatgtttcaccttctttcaagaagagcaagttccagaaaaaataatcatgaaagcatgtacttcaacatatcaaagtaatcagttgtaaattatatatatatacatagatataaacaaccaagtcacgtacacagacgatagtatgtatagttataactctactccagtcatttgtttttttataacattatcttttctcaataaaagtttaccaagtgcctttggttcttctattatttaaccctaaatatcttgctacagtgtcaaagataacatccatttcttctttagtgtatttttttagttggtcagccgcagtagcatctgtaaatgtaggaattgaaacatcctcttcattacgcaagccctcagtgattgcttcaagatcagattgtgggaatggcaatacgccataaaattcagctaccttacataaatccaaatccttgatattgctgaactcttgtaccgtttccggtaaaggaattttaagatcgattggcaaatcgccgtcagcgttaggtaatggaccgatcgcatctgctgggtctcttttattattgtttgctactcttcttattgatctttcctcaagataatcaagttgtccttgtaattcttccaccaattgttccaaatctccgttagtagcaaactcagatgtatcaattgacaaggaagcttccgcagcagcaggcttgttgggcttcttttctagatctaagcttctgatatccgtcttttgttgtgctatttgcaactcaatgacagattggccagtcttcgccaacattgtgctttgcctcttaacgagaccctgaagctctagaacttggtttcttaacttggaaatttcgtcactcatggtggttaatcaatagtgtgcaattcgagattagaaatacctctatcacagtagctttcctctttccttgttaatattctctttttgaagggtatggccatcattttgaattgttgatagtttcataaatagtactaaattttaatatcgatattgcaacacatcgagacaaagaaaaggcaggttagatgtcactagactaaacaactactggagtgttcaagaaggttccgattatattatgttggaattgaatctatagatctttataattaagtgcgaaataaatggtgaatttgaccgatctatgtataaaagtatcataagaaagcaaattgagaagcagatgaaaagaggaactgtttaaaacttgagactgttaagtccatttgtaatccctttcacggatttcttctccttttccctttttcttctcatcgatagcttacctttgctgacttcgtcagcagcttcttttagtctggcgatctcttcatccttcttaactagctttctattaccacttccaagttcataattatccaggaaatcgtcgagcatagattcgagatctggacgttctttgagcatatcaaagctttcatgtttctcttcatcttcagctaactcttcttcatagttttcatatcctccgatgatttgatcgtatttatcatctaacacagtcatcacttctgtacgtgcaagtgcacttgaactcattgagaatccagagacgtcagacatggcacctttcttatgacgggctttacgagctttaccaccagttttgctactagtcttgaagcttggcaatgatcctagcacgtctccatcttcaacttcttcctttagctcttcttcatcttcgctgtgattaattgaaccattgtcgtcatcactgaaatcgttctccgaatcccagtcgtttctcactttcttttgttgtagcttgaaccttctgacatctgcagaaacatcgataccttgtagatcctgcaattttccgatgtcatcgaactgtgccatttcctgtttataatgttcttcttcgaagttgtctagatcttgcatatcccattcatcaaattcatcttcaaattcatctgcaccatcggctttaccactacccaacaactcggcgaaaatatcatcatcgtcttcatctaaaccctcagcagcgttgttactcttaggcttgatttcgacagcaacatcctcattgataacgtatgcatcgtcttctaatgccaccaagacttccctcaaggcaggattcatatcaggcttgaaccccacaagttctcccggaatctcttgcatttgatccaaatattcttgcttggcaacacctctcacaaacaacggctcagcagccttgttctccagatcttgatagcttggctccacaaacagagattctggatccttcaacttcttcttctcaataggcttcttactcttggcaggaatgaaaacggaatgggatgggtctaagccaataggtttcaaatgctgtgtataatcgtatttggaatcgtcaaatgtaataccatatagagctgcttcaccgacgtgttcattaacagcatttttagaagctgatgtgcttggtgcagttggtgtagagacaagtttcggaattggcccatcttctgaactctgtgagacatccttctttttatgacgattctgaacaggaacaagaacatgttcacctgcctcgggatcatgataattaggatcatcgtgtggtctatgcaccacagcaaacttcgtcgcgttgttcttattgaatcttgttctaccggacattatcaatttgagttatctgaccttgatttcctgtccactgaaaggaagtatctatagaacaaacttcggttattctgctctaatatattccagtttggtaataatacaaagataatgctcaaaccgactgatatcacgaagatattcaagtaaaaagttacctcatcgcatctcatcgcttgatagaacagtatcttgaatagaaccgaatttttttttttccatacaggaagtggtgaaaagaaacaaaaatcacgtgatttgaaggattaaataggattaatggtccgttcatcaagcttgagcctactttcgaaggtttctgttgtttgtttgcatcccgggcattatagctgtgttaaatatcggtagatgcggtgggctttgtaatgacttttcgtgttattcgactctccatgtgctgccacatcttccaaactttgaaatatttcaagctcatcgcatctcatctcttttaccgaaatacacatagaggaggacatggttgataaacaacggtgattgttgttactgattcatttgagactctttggtacaaaatcaatactataggaagctatgtttatactgacaaaggtagcagatctggttaggatacctccagatcaattcaaaagagatacaatttcgaccattgtacatgaattgaacactaaatatgccaacaagatcatcccacatattggattgtgcgtaactgtttacgatgtactagacgttgatgaggggcaactaaaacctggtgatggcgcagcgtttatcaatgttactttccgcgctttagtgttcaaaccttttgttggagagatcgtaacaggatggatatcacagtgtacaacagaaggtatcaaggtttcactgctcggattgtttgaagatatatttgtaccacaaaacatgttatttgagggctcatatttctcgccgaaggagaatgcatggatatggccgatggacgatgagaccaaactatacttcgatgtcaacgaaaagatcagattcagagtagaacaggaagtgtttgtagacgtgaaacctaaatcgcctaaggagaaagagcttgaggatcagcttagggcaaagcaagagttgacggaagaggagaaacggatcctcgaaaaaccaccggcttatgctctactaggaagttgccaaacagatggtactggattagtatcatggtgggaataaaaagtgtatttcttaagtatgtatatatgtacattatatatttcttcaatcaaaagaagatgctccttgttcttagtattaagtctctaacgctgacttgtttccttgagtatgatgagggttataagcattctgtacttatatatatatatatatatatatatttatatacatgtacaatcagttatattgcatgtaacgtgaagtggaagagaatttcttgtaaccattgataaccttttcgacagcttttaagaaatctttttccgtagtgacttttcttctagctctaatagcaaacataccggcttcagtacaaacggatcttaattctgcaccagtagagtttggacataatcttgaaattaactcccatctgataccacgctcaacgctcatagattttgtatggatacggaaaatgttggctctaccctctagatcaggtaatgaaaattctaccttacgatctattctaccgggccttagcaaagccggatctaatgtatttggtctgttagttgcaaacatgactttgatattaccacgaggatcgaacccgtctaattgggtgattaattccaacatcgttctttgcacttcgttgtcaccaccggcaccatcatcgaaacgggctccaccaatagcatccacttcatcgaagaagatgatacatgctttcttagtacgagccatttcaaacaattctcgcaccatacgagcaccttcacccacatatttctgaaccaactctgaaccaatgactctaatgaacgttgcatctgttctgttagcaacagcacgagcgcaaagagtcttacctgtacccggtgggccatataataaaataccctttggaggatcgataccaagggtagcaaatctttctggtgataaaagaggtagttccaccacttctctcagtttttctatctgttccttacaaccaccaacatctgaatatgtaacgtctggtttttcttccactgtcatcatagtaacacttggatcaattcttggaggcaatggtaattcgatttggtacttggatctgtccacaccaacacgcataccttcttcaatatccgttggagaaacacgctctcctagtccgacaacgaacttcgctatttgcttcaagttgatcacatacttagcatcgtcatcgtcttcatcctctgtgccagaagcagcggccgctgctgcggctgctgctgctgctgctgctgcaactccatttccatcagcatctcctcctagtgcgttcccacttctctggggcttttctgccttgataatcttggtgcatctagccacctgtagtggttgttcctcacttaacctttgtctatcaccaacaatatcccataaatgtgatggtgctaaccctgtatcactctctttcacaccagctttctccttaatcttcttctcaatttccttcaagtcattctcgatagatttaagcttcttagcgtatggtgctgctccgtaagtcttcaacacttcaatgtccccttcggaaagtggcacaaccttcttttcctccttcgattcctcgtcttcaataggagccttgtacttctcccagtcttcctttggtggcataatgttttactgatgtattgcgctccttactaactcgatatataacgaattgacctcacttctctccattcgccaccctttccaaactgattttccatattatcagtctctttaaatctttagttcgatttccataagttagatttccactgttaagagataatgttacccggttttattgatattcggtaaagagttccaactaatgaacgttatatacgttatacatgagaggtctttttgtgtgtataaggttcctaatgaatccataatgctatcgtttgccaggatgtgtatgacatcactagggctccaaatattaagatcgccaggtctattgcttgtaattttttattattttcgaacactttgtagtggaataaaggaggataaatgtaaatcaacggtatgcaagcgaaagatcctattagagacacgaatttatccaaatcgttagcaccgatccatgcgataatcactgcgatgaggaccacgaacgctctgaaataatttttacgccatttcaccttagcgtcaaatttcccggacgcattcttatggaaaatcttgttttcgaggatctttatagcagggaataattgcaatggtgtcgataggagaattgccagagcgtaaattagttgtactgcgtttgtgaagatactgttcgaggggaaattcaacaagatgacagtttctactttggctccgaatgcagagtaacagatgagcccacaggagataaatattattgttacaacgaggatgacgtacatcaatgccggtttgaaatgtgcaggtttttccatagattcatggattgggatcaagagaccgataccctcatatgtgaatatcgcagttccaataaataacgtccagtccgatttgttgaaagacaccatggaatccgaagcgatgccatggttccaaatatagaaactggaataataatagacgtatactagacccaagagaatgaaaagatctgctaccaaagcggtggcactgagtcttgcaatgtttctagtcaatgatagcggcaaatagaatgctagttggatcataatccagaagattaacgagtattcgagagaaaagacatgtttgaagaatgcctgcaagtttgttgcagtgaacacagtataagcagcagcaaatccgatttgcgagagtacaatcgatgaaaggacagtgaacttcaatttgggtccgaataaacgtgaacccaattcaccgtatccatccactccaacagcagtcttcgtgtctatcaacaggatgaagcagtagaaagacaccgtggcgcagaacaaaagacacagcgtactgaacaaccacccaccgttatggaaagctctaggtagaaaaagaaccccggtacctacgaacgactttagaaggagaagtaccgccttcgtggtggacgtatttcttttcttcttatgcaagtgctgctgctgctgcttcagctgctgttgttgctggatatcgttattttccgaactaccttcgtcatcatcgatggccatcgatgaagtctcttcgccataccgatccgctccctggtggcgcaggcccctaataccatgacgaagaagcgcagcttcttcgtcctcatcttcatcagtctccacctcagtttctgtttcctcatcctcggacaaatcttcaccagcgaaatggccgtataacgtcaagaactcgttgaaattcctagtgataaagttcggtgtcttcccatgaagtttcaacgacttatgagcgatgaaagatcttctgaacccattcaatcctctcatttcctgagctgacatatccaatgggttctgagtatttcttgcgaagtttactgattcagagaaggacatcgatcttcttctcccattaaacgaccctaaacttcccaccggagaatcgttccatcgaggtaaatcggacccattccctccagaatctttcttgatattgatattcatggcagtgtatacacctctggctggctctgaaaggttttgatgtatgagttacagtgaaatggtgggttatatgtctggaagtgttgcatttatacatatatagaatgaatgtactccagccgaaagagaaagaaagagagaaaaacgggaaaagaaaacaggtcacgtgagaatagaccctggttcacgtgttcattaaacagtagttaccgatgttacccggacaactgtctcctcattgaaaatggggagggcgctcattatgtccgttggtcacagaccgggtctaatgatgtgagaaactggagagctgtgccttctgcgttgttacccggtcatgcgtcagcattagcaaaagcccttttgaatgacttagtgctatgaatggattcagtattatgtccagaaaccattacggattagcactttgtagcacggattaatttacttaattccagtcagtaatccacctcaattccagagcagtcacttttttccttcattattaaggtttctttagacattttgtttcctcgttatttaagggttggagaagtgttcattgtgatcttgacacattgtggggaaaaccctataagtatttgaggacgaaacattgttatccgcatatataaaggggatcggtaaatcagtttttcaattgcatctcatcactttattatactatagcatagtattggatgggaatcagtcaatgatctaatattaattacatacaaagagaacagaacggatcacaaattaaaattatgtcgttagaatttaaggacagagtagttataattacaggagcaggtggtgggctcggtagggtttatgcgctagaatatgctaaacgtggtggtaaagttgttgttaacgatttaggtcgtagtgcagcggattcagtggttcaagagataaaaaaattgggtggtgaaggtgatgctgtagctaattacgattcggtttccgataatggtgcagcgatagtagaaactgccattagcaactttggacgcgttgatattttgattaacaatgcaggtattcttagggattcgtctttcgctaagatgtccgagaagcaatttcaacaagtgatcgatgttcatttgaacggtgcctttaagttgactagagctgcttggcctcatatgaggaaacagaagtttggtaggatcataaatacatgttctcctgccgggttgtatgggaatttcggtcaggctaactattctgctgcaaaactgggtttactcgggtttggtgaaagtttggcaaaggaagggtataagtacaatatcaacgtgaattcgattgcacctttggccaggtcagcgatgactgaaaatgttataccagctaatatcttgaaagaattgggtccagagaagattgcacccttaatcttgtatttaactcatgaaaacactaaggttaccaacaatatcttcgaattagctgcagggttctattctcaaatcagatgggaaagatcttctggtgaattgttccacccaaacgttgagacactaactccagaaactattttacccaaattcaataagattattgagttcaaggataaacctttcaacaaggtacaacatcccattgaattatcaaattataacgatttgattacgaaagcccgtgaattaccagagaacaagaatggaccaattccaattaaatctttgcgtgggaaagttgttataatcaccggttctggatctggtttaggtaaatcacacgctcaatggtttgctagatacggtgccaaggtggttatcaacgatatcagggaccccagtgctgttgttgatgaaatcaataaaaagtatggctccggttccgcagtagctgatactcacgacattgtgaaagaggctcaacaggtcgtacaaactgcagttgacaaatttggtcgtgttgatatcttggttaacaacgccggtattcttcgtgataggtcttttgcaaagatgacggaagacgaatggaatgctgtcatcaatgttcacttgttttctacttttgctctatcgaaagccgtttggccaatattcttgaaacagaaatcgggttatatcattaatactacatctacttcaggcatttacggtaattttggtcaatgtaactatgcagcagcaaaagctgccatcttgggattctctagaactttggctttggaaggtactaaacgtggtattacagtgaatgtcattgcaccacatgcagaaactgcaatgacaaagacgatattttcaagtaaggaattgaacaatcattttgaccccggtttcgtgtccccatttgtggtacttttatgctccgatgaattacaagaactcggtaagaaccgtgtgaaaggtttattgttcgaagtaggcggtggttggtgtggattaacaagatggcaaaggagtagaggcatcgttaacagtgatgcaacgccagaatatctagccgaacactggaaagaattaacagatttcagtaagggtaccatgaaccctagttctactcaggaatctagtatggcaatacttcaatcagtgcataagcatgcagcagataaagctaaacccaagacttacaagtatacctctcgtgatgtcattttgtacaacttgggtcttggtgctacaacaagggaattacaatacacttacgaaaaccatccacaattccaagtgttgcctacatttgctactataccatacatggctgatgggtccattgatatcaaattcgatgagttagtggataatttcaattacgctatgctattgcatggtgaacaatatttcaagatcaataagttcccattacccactagtggtgagttgagaaccactggtaaacctttacaggttctgggtaaaagctccaaagcagccattattgttggtgggtatgaaactgttgatgcgaagaccaatgaacctgttatttacaatgagggaacattcttcgttcgtaacgctgtcgttccggataataaggttatcaacaaggcgaaggagagatcaccatttgcaacgaaagcgtttgtcactaaggacttaggtgaccctgattttgaagctgaaatttctacttttgaagaccaggctgcattgtaccgtttatccggtgactacaatcctttgcatattgatcctcaacttgccaaatcagtgaaattcccaaaaccaattctccatggattatgtacccttggtgtgagtgccaaggaactatttgaaaagtatggtccattcgatgaattaaaggcaagattcactaatgttgttttccctggagacagattaaaggtaaaagcatggaagaagaacgatgttgtcattttccaaactactgatttgaatactggtaagatcgtattggacaattctgccattaaattgatcggtaaatcaaagttataattctggctttgtgtgtcagagagcgtaagctgtaatgattatgtcccaacgtatattagtttgtagcaaataatgaataacgaccaattccaatccgttttcttttgacataaaacaatttatatctctttacttatatacgtttagtaaaaggatgggtcctatttatatgaataatgtgtaattgaagtgctttttcgaaagtaacgttctttcgagggtttatttcataaaataaataataataatggtgctcagaagaatattttaattccttacttctaggctttgggattgagaatatgcttcctctcgttaagcatatctagagagaaagcaacctgcaatgacgaaagttcaaaaaaatatcatacgtataacgcataatcaattattgaggactgtcttctggagcaacaaccttaacccagtggtcaccgaagtatgggatctttctgtagaaggcatcttggaaagttggccagccatcggtgaacacgaataaaccgaaagtagaagcaccaccccaaagagccaagtttggagcgtaactcttcaagttttcaaaagtgattctaccgaagtgagcagcagtctttgctgatagtttagaaacgtactgatgaagataattgtttagggaaatatcccttgacacatgaaatgttagtaaaaaaacagtcttcaaagggcttatatttgcccaagatacatcaggtatatgaaagatccttcctaaaggtactcataaccttacctttaaggtctggagatatcggtatacctaaaaaaatctggataattcagttatgagttttgatctactccatctctaaagtctctttcaaaacattaaccacattccagacacatgtctacacatacagcaaccattttggaataagtatactggtgtttttcagctctaaaatagatatctgcaacgttgaccaaaagcacatcccatagtaaaggtataatgctccagttaattgaattgaagcttttttatcttttttatcatatagtgttgatgtcattgtgaacgacgtggacagtgagatgattggttgtaggtcacgtgcaaataggaaatttgggtaccatgattacatatctgtatcggttaactagtagaacaaggataaggacagacacacttggcaatcagggactgttaattatccaattatttgagttctgttgtcataggctgtgtcctgtccatattcttattttctggtaataaatatgagtagtgtttcttcacttgtgataaggtatctggcctctgcagtccattcacatcaaagaacttactgacgcaactccaacgatgccacgtgaaatcttttgaggcttggcaattgcatctcaatatttctttcaacgggttatctcttggacaatcttgatttggattgtgtgcgtaccctgtatcgggtacaaaatggatttggtcaacgtctagtaacaaactaaatgcaagcgtatgaaccggagcatcgccccaacgttcgtagaaaaacccaccaagtgagtccaaatattggaaataagattcgtacccataactcgggtctttgaatatctttaaatgggcaatctcaaagttagtccaaaaatgacatccgttatacgtggctccgtcatcgtccgagatgaatttgaagttgtttcgtttgctgacaagttcagggtgcatttcgaaaaaatacttatacgtatgttcccataacgtcgggatcgtcttttggtcttcacccatggccatggcaaacccgtataatttgtcgttttgtctcatatgctggaatacatcatagtttatatcacatccgaatttcacgtaaggttccacacgccaatagtattcaacatttgctagttctggtaacttgtaaaacaatccagaattgaatctacacatgaaacgatacgattcgctagcgccataagcaattttctttttgcccatttcctctctaactttggcagcttttccacgatcgatattatctggatagtcgaaaaattctttcggaagcgtgatatactttacgttaccgctaacttcattagaagtaccattgatgaactcttcagtgaactttttatcgtttacaaaccaccaatcgtaatggtatttcttgttgaatcgtctctcgaattgtctaattgattgcaacataccatccaattcctcgtttcgcaccaaagaaagtataatatcattacccctatcatcagtataaaacttttcaactggtttctcgtcctgtaccgatgattttggttctgattctggttctggttttaactcggcaattctatcttcgatcccataagtcgaccagaatccataaattaatccgattatcgtgatcaatatgataccatttcgtaccgttcttttcgatagatgtaatttaccgatcattgcatggtcaattgatatacaagacttattttgcacagtccggaaaccagcctgctgatactgtacttaagtttcccattttatatcaaccatgttaagttgcttttaaaggcaagaaccgacatcgactcatttgacattttcatcactgaagccatggtaagaagaaactcggaaaaacgttacacaggaaaacggggcgttcaacaatggagaaagacggaaaatggaaaacgagaaatttgaaaaaaaaaaattgaaaaaatgaaaagttaataatgaacttgttttagaaagtataataaacgaatgaattacataaaagttatgaaatataaaaatgtctataaagaatcgctgtgtaaagtgtagtttatatgtgtattcaatgtgtgttgttgtttatatctcaaagtagaatacagcaacagctagtgatgtgaaagaaaaaatgaaagtttttagagaaaagcgcggtggtggtattattggtgtcagcgtcagtgtcagcgtcagcagcgaaaatcaacgacttttttaattttaattattctagtgacacagaaagagacaacagtaaggtgtgaggaattggtacatgttaatgatttgtttttcacccaagaagaagtttgggtggaaaggtgttacagatataggagctgaagagttcttttttttatggggtattttttattctcttgttttttcccttaaaacctggtttcgattaacctccttcaaataacttgattgatgaatgaaccattactataataaatcttggaaataagcacgaattgatctggaaatgcacagtcatcgaattgtgaatcttattctaatagaaattgttgtttttttttgttgttcttttattctaatttgtctttatgttttttggttatctcatctcaatcagttcaagttattcgaataagctaccagcctacagcttctttgatatatcgaaaaaaaaaaatattatattgttaaaaagatgccctctagtatcctctccataccatgaatattgttgaatattgttcgtatttcttcaatttcttccccttcttcaaaatgaaataacatgacctcactattcatgttaccaaaaaaatcctttgtagatgactaccgctcgatggtctaatcactggaaatgtttaaaaagaaaaactggttgatcatccgctagttgatgtttcctttgaatttttgaacttcaatgaataccaactagaatccttatttgaaaaatcaaaccaactaggcttcgttgaagctgtaccagcagtatttgcagtcaatggagtaaccgcactctgggcagggattgccattggtgatcttggagataatgaagcagctgttgatggcccaccttgaaggttgagcggtgacactggactgatgtcgaacgaattgatctcacttgggacctttgtttccaagaaatgagtgtcatacacactttcgtcagctgaacccaatcgcaatgtagctgacgatttttttgaaaatgtggatgccactgtattgaatagttccgttatgttatcacccaattgtgcaaatgcaggtacttttggttttctttcagaatctccttcagtagattcagcatcgatcgaatcatcttttgaaatagtggtcgccaccgctggattggatataacatcatgcaaagatatatttgaccttaacttatctctaataaagcgggcacctgaactcttcccataactgccaataggatcgtcaaatattgggtttgaatggacagtcaagtcatccttctcatctggttttgtcaatcctagagatgctggtccaaattgattttccaaatcagatgacctttgttgtcgctttggctttatatcctcttccctcctcacacaatcgtacgataaaagatgatgatgcattccaagctttttgaacatctcagagtgcgaaaggtgtctgtaatcaccgttgctgttatttcgaggacgattggaaggcgaagttttggaaccatttttggcaataacaagtggcagagtttcctgaacatcattgtggacactatggcaagaagaagtatccgtcatggaatgctgatcatcgggaaccaattcaggaaccaactcaggaacagaagcagtattagatatgacttggtcttgtttctccacttccacacgttcattcgctccagaaaaagtacgatctttcttcgaattagaacaatcagttaactccattccatttaactgcggcccgggattcgcaataaaatgggcagggtttctaattgataccaattcttcggaatctcgtttccgtattctgtaggattcacattttggaatagattcccaagtcaagtacttgtcattcatgggaatgttttctacgttcaaagtttccaaacatctcctcaaattccgcttcttgttcatgacgtaagccaatgctctggatactgcaaaccttttcggattagaaattacactcagcgatatgtctgatttaagagccactttcaaagcttcatcgacagatttttgacagtttgccttatggatttggagctctctatcaaaatattttgtcctttgttctaaagtggtagataactcatggatttctcgtttgtaacctctttccatcctttcaaaattcaccttgtgaagcctctttgtgtcttcaagttctatgtttaagagacatttttcagaggatagccgcgccctgtccgatctgtattcatggagacgcttacttttgctatctagctcggattgcatatctaaaaccacttcatccttgagttctagatcaaacttcaactgatctatcatgtcatctttctccaacaaagcgacctcgtaatgagttctatcccaaaaccctaatgttctttgtctcttttcaggagataatgcgcttaactcgtgtatttgctcttcatgtgctcttttcaaagaaactatctgggaattcttcacgttaagctgctcttcagctgctttgaatttctctttgactttaacgtatttcatctgcttgtcatagacagatttggtaatcttatcatatattcctccaagtgctctgaaatcatcacactctttctccatagaacgatagtcatcttcctgaatctttgcagcatgtgtcttatttttcaaatcgttgagttcagtcaaagtgctcagaaggttttccttggctaacttgagattatcaacagttttgaaccaagccactttgaagctttcaatatccttcttgcgaataacatcgcatttttcaatcgctttgcacaacgtatcatttgttgtctggaaattcatatcgatgatagtaactttggcatccttgtatgctttgtaatgggccaaatcagcttgtagttcgttgatcttattctccaaggatttcactttttcctcatgaacgtctttgagtgattcaatcttttgctgcataaattccaatccaacctcatggtatgtggccttctgtaacgcctctttgtagcgtttcttgcatactgtcgtttctgacatggcaattttggaaacgttccataaaaatccaatagcttttgagagatacggatgtaaacttaataaggcaacttttaaatcatcagtacctttaacttcttcaggagcacctaacaattctagtagcccaatgagtaagtgctttgtggatgaatcaggaaagggcacaggaccacaactgtatacatcacttaaagatgaaacttcggaataatgtgaggaatcattagtggtgttagaattattggtatccagggattcaacttttgaaaagtcgctcttcgtcataccttggttataactacctgcacttttagaccttgttgtagctgagggagggtttaaagtgtcatattcctgaatctcaacaccatcctgtgtcaaggatgcaaattctacattcttcctcgcctcatccacgacgacagagtccattttaggacccggtttaagcaattctgatgaggcaaacaaattttgaagctcttgaacgaaactaggaccattgacatcataggcttcatccctatgtttcaaaaaatcgttgtactcttcaaaataattaggattatcatgcataaacactgaagaaagcttacaaaagtctgatattgttttattgcttttagtgatattcttggcaaattgttccaataacgattgatttcttgtaaaaggcttcactttgattactttcttcacctcaggatcgtcagattttttaacgaattcgaaatctttctgtctaacctcactgtcaatcacattgaatttcttcattaaatcagatccctgcttcagaactgggttaagatcaaattgctgggaaattggttctattgatgacaccaagtttgacagcagttttttctttcttttcttgttctgcttcataactacaatagaatcatcaatttgatccaatttagtaacggtaacaccccctttccccattcttgcatgttccaaactcaaatttggtgacagagacaccgaagataatgctgaagatgacgacgaagaagaagtagctcttgcttttgtatcgaactgatcattttgcaactcatccgaacattccctagaattaccagattttttcataatggtttcattttcgttgatggcatacgttgattgatcaactatgggtttacgaacatctacaatctcttcctttccttcctcgttcttgtatagcatgaaatgtctatcagcatcaattggttcatccttaaaagtctttatcgattgtgttgcagtcttaacaggtgcataatcattgaaaacttccgtgccaggttgatcatagtaatacaggttttcagaggcattgatgaatttttcatcaatggcagtagttttattgggattgaaaacaaatgattcttcctcatctccgccattgttgtagtaagtactagcatggcatattgaaatattccccacgtcttggccccttgattttgagctcgatttcaatatgttttcaaacttggaacttgcacttgataaagtccttttcaaccaagatggatcttgtttgttctcagactcaagtgtcgcagtaacaactggtgaatgatcagagatgttattggtagtttgctgagagaaaaaattctttttaccgtttgttgaacttcttttgcttctaagtctcttacttaaatgtttctttggtgaaagtgaagaatacggataagacactgaaaacctactgccagtttcggactttggtggtacaaatggcttatactcaacgatttcattttcattcatagtccaatgacgggtagacgaatcatttgtattcagatctaaagatggtgggggtgtaaataatctcattgttgttacacatttatcatctgaaacattaggtttcgtagggccgttgacagtaccaaaatagccttttaaagcagctctcttatgcccttcattcgaaaaaaatttcgaaattgaaattctttgccttgcttcttccaataagggaggaggaactggcattctacaactcccaaagctttgtaacttttcaaagccactcattgatctttgtttcccttcttatcaaaattatgatcactgggctgatgaatgtacattgtattgtaatactgaggataataatctggataaagtgacacataaacggcatagatttgatcaggataaaaatgtaaatcacaccgatatttatactttttgttactctttccaaaacctctgggcgtactgtccacaaaagttgacctgttttggcacaaaacctatcccatagtaatccagaaaaaaaaaaaaaaaccagaacttacctaaacttcacagcgccagcatgctgacaattcaacgtatcttcataataaaacgtgtcagtttctggtcaagttcgacatttttgtgtcttttgcagtactattattttgtcaatgaatcagagaagaaaaaaaaaaaaaggaaaacaatctgtcgcgcgacaaattgaacactcatgtcaaaaataatggcccaatgctttctgataatctagagcaccttccctgcacgggcgaaagaggaatttatgtcttgccgttttatcaccatacccatatgcaaacttaactcaccacgtatcaaaatatacaacagggcgtcttcatgttccaccaaaaaaaaccaggcagtactgcaataaaggaaagaactttactgggaaaaaaatcaacaataacttgcatctctgtctccttaaatacctgaagatgaaatcaatcaaagcctttggcggctaattttatttccttgtttattctaatttaatttaaatcatcttattctaattaaatttgccttaattaaaggaaaggaaaacaaacaaacgaaaaaaaaaaaaatttattggatcaagcagcgcttgtttttccacatgtagtaattctcactagagattctcatccagtctccttttgttaacttacatccttttaatcttccgcgtcacgttacagtaacaattttcgttttctttatttggttgatctttttgtttttttgttaggcgcgcatttttgtgggggagaaaatgacatgacctcagaaagttgagcagaacagataaagtggagaacatacccgaaaatggtaacagcacataagaggtcgtaccgaaatggaactgattatggtgaccgataaataattaataaactgactgtgtcacaagatgggaaaacgtccggtcccgatttatctcttgagcgcagtgaactgaggccccgaccattggggagaaattcaaaagatgatttgaacggctcttacctgaggaaagtgatgatcaaacttgttgatactgactcaattaaaggattttcaaggagcttaaaggatttatcaagggttctgatcaacagacatattatagtttcctcctcttgggtcggatgccgataacggattgcggctagtgtctttctcgtagctaccattggtttttagtgatttatctccatgtagtcatcgaatgtttagacattaaagtaaaagtaacaaaaagtaacgatccctcagtagtaacaacgttctttattgtgaactctttacattgtatatataagacccagatacaatctaatttctcacgatgggcagagttcgatgcgttgttgatagcttttaatgttataagcttagtatatgttagcttgaccaaaagaaaaaaaatatatcgcgaagatgagttttcgttgcagtgttaagttcggtgaaagaagaggatcttttcttatgagtagaggattgtctaatatctctaggttccccaagccaaaggacgccgaaatcgaaaattttgttaacgctcaagctgaaagtattgcaaaatggtgggaaagtgatcgtttcaagaatatcaagagaccatatactccgttagatgtggtgaaacatcgcgggtctcttggagacgatgtggtctatggatcttctattcaggccaagcgtttatttcaagtgttagaaaataagtttaagaacaagttaccggttcatacactaggtgttatcgatcctgttcaaatgtcacaattggctaggtgtgatgatattgaagttgcctatgtctcaggctgggcatgttcttccactatggtgggatcaaccaacgaagtatcccctgattttggcgattacccctatgatacagtaccaaaccaagtagaaagaatctttaaagctcaacagatgcatgataagaaacaattgttgcaatttttggaatccaaagatacgaacaaaagagtagattatttgaagccaattattgcagatgcagatatgggccatggtggcactacgacggtgatgaaattggcaaagttgtttgctgaaaagggtgctgccggtatacatcttgaagatcaattgcacggtggtaaaagatgtggacatttgggtggtgctgtcattgtaccaactagtactcatatttccagattggtagccacaagattgcaatgggatatcatgggtaccgaaaacttggtcattgccaggacagattcttgcaatgcgaagttattgagtagtaacgttgaccccagagatcatgaacacattcaaggtacaataaataagaatgtgaaaccttggagtgatttcctttcagaattggaattcgataatgcgccatctacaaaaatttccatggctgaagctaattggtacaaggaaaacaaactgtatacgtttgaagaagctgctaaggagcaactatcggagtcccagttccaaacctttaaagaacaatggaacaagaatttgaaacttggtaagagaggatatttgtctattgatgaattgaagtcgttagtgagatccgttaacggtgggtcagatattgtcttcaattgggatgcaccaagaaccaaggaaggattttatatgttcaaaggtggcatgaagcctgccattcaaagatcgttggcatttgcaccttatgctgacttgctatggttggaaactaagtctccagacttgaaacaggctcaggcattcagcaaagaaatccatgatgtttaccctgaagcgaaattggtctacaatttatctccgagcttcaattggagtgcacatggatttgacgacgagcaactacaaagcttcatttgggatcttgcaaaggaaggatttgtcttgcaattagtgtctctagctggattgcatagtgatgcgtcctcattctggaaattggccaagagataccaaaccgagggaatgaaagcttacgttgaagaagttcaaaaagttgaaaaagagaacggatgtgatgttctaacccaccagcaatggtcaggtgctgaatatgtcgattctattatgcaagtagtgcaaaacggatcaagcagtcaaactttgagtactacaggtgaaagtttcactgagactcaattctaaaaaaccataccctagcgcgcgagtcaaaaactttatgcctctttatttttttatttgaagacttggcaagattaaaatatacatcactgtaacaaaagaaggagatggacagtttatcatctcaaaattttatacctctacgcaaggatatagttctagcacttaataatatgcgatattcgttttcttttaagaagtgtgtttcagcggacttttttttgattatttaacgcatatttacatcttaacggtttggaagcgatgaggaagtaaaactcggacaaacgcacaccttttgatttactttaaaatcgtttgattatcttgcgaaaccaacagcatttcacaaatgtgaacattttcgttaaacgtggtaacttcagttaaaagtgagacatgcgaaaaatcgcataataaacaaagcgcaaaaaaaaacaaatgcagttctaatggttttttttcccgttatcaaaagatgataaagtcagtcgcactgcggtaaaacatttaaaaagcgaaaaataattctattagtttaagaagctaaagtatcctgcggtttttttattttactgcgatggtttgtaattctgttgtgtcgcgttgcaatattgtgccgccgaagtccatattagccattcacctatataaggataaacgtttagattagaagatcataggtccaaataaccagctgaaaggggagacactgaggttttaagtaaccagggggccaaggtaacacgaaatgatttggacttacgagatggatctcgctctatgcaagcttgtttatttgaacagtccagaaattctaatagacggcgtcagagacagaactaagaattatcacagcgtattgagcgatttcaacaagcagtttaggcttcaggtaaagcaggcacgtacggtgagagcgcgatttgagagattgttactggattataaaagtagggcccagacgaaatttgctccaacaggaagagaatcagagatcgatatgctgatgaagacattggtcaacatggaaatagagtaccacgaaacccacaagattaccagtgttccgcctggagatgaaaatatcaatgcgatgactactggtgatatggtagaaaaggccattgatgctttgaaagaggtaccaaatcagacaatcgtgaataacatgcagaaaatggggcagccagggcccaaactaatcgatgttactgggaatcaaaacttaccggctctatcatcaaacggctacaatgggaaacaactcccctcagttcaagttgatggcactcttatgggttccaatacggagggaaggaacggaacacgggacaagacgggacaaaacatagataagaacccatcagggaatgcgaattacacacatggtaatcaatctgacctagaagaaaacaatgatggtcaaggcattaactaccctaatattgacacggagttacagccgcctgcgaagaaatttaaacacaatatagtgccagaatcgcaaccatttaccatcacaaattatttctcagacaacaaaacctttattatgaatggggatggaggaacacaacatgttagcggtaaaagtgatttaaaggaagttacccaaagagtacaaactgatctggaacatttaaaacaagatgtcggagaattgtcgacgttatctaaacaaattgcaaaagtgttgaaacgagttacgtcgatggaggagactgcacaggatgaacgaggatactagcttatcacaggaaccaccgtcaatccgatgtaatattaataccacaaccactaacaaggcattcacggttctttgtaaagctatgtactgtgctaattttgctaccgataataataagacttatcgaacgtccatatttctgatcacgtgtatgaaatatacagcaggggtgcaactgtttatttaccaaccgaaaatgagctttatgtctaaaagtgatcctgtgtcttgccttctaggtaggggaaaatttcgccggataaaacacgaaagagaaaatgtaggaaaatacgtaattcagtttcagcgcgcataattacagatttgcacggtaaaaactcatccgcacccccacagtattacagttttaaaggggggcggcgaggaatggtgcagttttatcaacgttacaaggtaacttcataaaaggaaactacacaaacacaccactcttccctgcttccggcatctcgtgtgttcagaatattagctaataaaccagtagttataacttttctttcctcctttggagttgcggtcttttcctgtactccgtaagcgcgtgtttgtttgtttgaaagaaagaaaaaacgctgtgcaaatctacggttgagaaagaaaagtcacaattacatgattttacactacttaggaaattggggaacgtaggttactgagaggtcccaaaaatagttcgcctcgggaacagacacgcgattcatactgtgagcattttgttatattgtgcctcttgcaaccattctttaagggggatctaagctgttcatttaaatttgtgcactattttaagcatattctcttgccagtatttcgactttcactgtcctcccaagaaaaaaacataataaaccgtttgatacaaatattcacatttttgaactggtgcggttgtttttgcactcacatattttttcccagttttctcacttgttttaaaattgtgtgtaatttcgcttttttttttgtagcacatttttgggtcttggtttttttcttgggaaaaacagtgcgagagaagtgagattcggtaggctgcagttattttcagatccaagaaatctctatatatgaaccagaaataaagttcagaatctgatttcaagcctcgaagaggttgcaacaaaattaaacattagacatttcgcatactttagagtaccaaaaagcgtgcaattcaactggttattatcggttagtaccatatcagcatatcagcagctgagcacccattgttgtgtgtgtgttttctgctttttcgtcgatcatatatttcaattttatgggatacttgaacattagtacttcaataagattttgaattaaagattttttgtgttctaatcctcggtgtgctagtatcgacaactcacttctaaaatgatgcaactacctactgaattggtgtctgatttggggacttaccaattaaaatctattttagggaatgataaaggaaatgtaatatattgtgcgaagaattctaacggctctactgttgttttgattgagaccgacaaagttcttccggtgaaggctaagacgaggttggatgatacttataaggacagattctatgataaggatcatacgaaaacctttaccgtttatggtcaagactatctggatattgaaggaaacgactactttgcatactcaactgatgaggatcactcgttaaagtcacgtgatagtaatgaatctcatcatgagaatgaacaatgtaaccatcatacgcaggagaaagaggagcagcttgatgctgaaagtcaacacatttgttttaatggaagtgcggagatgaagccatgtaacaatattttggctagaatgaaatgcaaactgggactacgaaccccaatgatgaaagtcgttccaccggcaagggatgaggatgaagatgaggatgaagaccaagatgaaactatcgaagaatctgacgataatgataataatgctgatgattcagtgtcagatttaccggatataatattaccccagactaccgttccaaaagcaattgagaaaccaacctcaattctcgataaatcaactcatcttagagcatcaatttgcatatctgacaatgtacggcttgctccttgtgggaagaagcggattgtcagccttccgagaacgccaataccaaaagtattccctgtctcggatgttgaagccggcagcgaagatgacgaggatgaagatgaggatgaagaagaagatgtcagtcgcagcggtacggaagatactgctgatgacagaagtcaattaacttttgataacaattctaaattcagcaggaaaatattacaagacaacaacgaagctgagggaagcgatgacgatgatgttgacgctcatgttgaccatgacaccagctttagaaatagaaaaggtgatattagtgaatcagctgaagatatcaatctagtttccgctggagtatttttaagtgaaattcctcataagaaaccaaaggaaagcaatttccaattgcaacacgtcgataggatcgtcgatgaatcggtctgtaaccatgataatccgatatttttagagaatatcaggagaaacagtgtcaacaacactaaaatgcatccactagagttgaattcggatcatgtaaggcaccgctctaaatcgctaaacaataattgcggtatggatttcaatttatgtcttgatagctccaaaatgcttactagacggaaaacaaaggtatcactggaacgactcacttaacggaattaaagagatgagaactactttttcacgatagcaacttcaatacatataaacgtgcagtacatatgatatactcgaccatacattcgcatatcagcattttttttaatcatttcgtatgtcgtagacgtttttcacatttttattggcgttcctaacagattgcgattgaatcagcctaccgtttatttgatcgtttgctctaaatctttgtatgccttcctctaaagacaggcaaataccagatttaacatgacgtttggccactctttgttcgataacatcttcatcaatcacgatattccaaaaaataaatgcacccgtgcttgctatggcatcgtatattagactccagttctcttgatttaagagaagatagagtccttctagaattagtattcttgtaaatttatgaactgtatgctggtcagccactggatctttaattgcatgatcaaacccggggaaagatatttcaggtaagtctataaagctattcgtaacattgtcgaacaatgaatttgtattatcttcatttacagtctctgggccagtagaatggtagtttgggtccagggaacaggtttttgacagcactttgcacaattgcaagaaattattactatcaaacgtaaacggcgacccccgacgaagatgagccacagtaggatccttgaagtgatctagatgttttcttgacagatggaatccatccattggaacaatttgagctatatccggctttgttggggacaagttggcttccttacgtagcggttttatcctaaccgcattgtccaaaccaccgcgaccaacgataagggttgacccgtcagactctttcacttgcactggtttgaaattattatcttcgacgtgtgagtaaaatcctgccttaatctccgcttgcagttctttgttggcaactgataggtctccagttagatcaatagcagagcttaacggccgtactgccacctctgcatgatgctcgtgagctaggtaatcgtgatatctgctattgatcttttccttcaatttttcagctacagtcgacttaccagaacctggtggtccaattatcccaatgcaaaccctataattcttgttgatattttgttcgagcagctgtaacgcttgatctacaagcgcatcgtaatccaacatcctatgttggcagtttgtaaaactgaaaggccttgtacaatgatattgacatacgctgatgtaatgttctttaagaaacagtgttctaaaataaattgttttggtttaaatgttcttatttaatctgtgttctgtaagttcactagttgtggatacgatatttctatcgtagtcacaaggaaaactaatgaaaatagcatcggatgtgccatgggaaggagttggaagtggagatctacccttggaatagtagtctatctatcaagtttatatatacatgatatacgtatgtgtgtacttttgttttacattgggtccctcatagtgcccttcgtaaaatgttgctactcgaattgctcaagcaaatcccatattaacgctctcagcacggtatcgccattcaggttaatgaatgagaatattgggctatctttaatagcattgggctgttgatgcttatcatttagatttttggcaaaactttgtagcgaagaagtgctttcacaatcgctagttgggtcattgattaaagtggatttgtcaattggatccagattgttggtagaatggaaacggctgctgccatttctctgtatgtttatcaagattttaccggataattgcataaaactttcgtattgaagtttcccaatatgccattgtttggctagggtctgtaacagtttctggtatagtttgataacgttgatcgatctcacactatcattccgatcaccagatattagatctaacttaacgttcaaccaaatacaatacatataagtgacgcctgcgacaaataatgtatggatagaggtgagcgggtcgatgttatgcgacaagggagataaggactcttttagtatattttcgtagcatgtacttatttcagatgcagaatacatgagtacctgaaaccattctaacgtttctcgagtcggtgttaccatcgctacaccatccgctacggcttttctatgagaatcgttgatttgaagtaatactggtctcaagaaccaaaccacagactggtgataattcatatttgcccaagtgtcagttgatatgaagttcatgtccttattcgatttttgtgaagagaatccctgtttccaatcttccaattcaagtatgatctgttgtcttgattgattgatctcatcgtcgttatcgagaaacttacgtggaccatacacgaacatacatatagaggattgaattcgtcttaatttgaaaatttcaatggcattagcatacatatgcgtttcacaatctgctgatcccaaagtggatcctacttctagttcggattctggtaaaggagcatcaatatccacgtcggatatgcaaaacggtctacccactgtcataccaatcaacctttcaatgctgtacgcacaccagaatacccttgaccttaggttctgtaaaacgtgttgttctaagccatgagtcatgcttcttggtgatcctggtttcctgtgtaaatctaacgaaaccgctgttcgtacggccactcctgcaagaagccataactgattatagtcatctgacaaactctccttgggttttaccagcagttgaatgatcagtagtaggtatagttgaatggtcctgatgcttcctgcttctaacgtggagttgatgtgatccatcgtaatcccatagtataaactagaaggatgagctccttcaacaacttctcccaagtcgacaccaatagacaacacgagatagacgaatgaaatcgctttggtatccttcgtattcaacatgaacactttgtggaaacaatcaagtacccatggccaatctaggaacggatactgacgatgaattcttattcgatacagttgcaataatttgacagcggtatcgtacgacggcctcaacagcgtcgagtccgagtccgagttctcctgtatactgcccagatcctgtgaaatattcatcttgagttgggacccgaccaccaactttattatcgttttgtcctcttctgtggaacgcaacttggattccaaatcgaaaacctttgattctaatctatcaatataatctctaggtaattctcttcctgtaattttatctacaaaagtacattggatcccagcattcacacaggctccacactgagggaacccaccatcacaccgtttcctccttctcttgcaaaaacagcacgctactccctggttcttgcgtcgttttttacttgcactactcgaattgctatcgtttccactactattacttacagcatcattatcaccaaactcaaaatcaactatattttcgtgttgtggttgccccgaatgttgaccttgaccttggaactcttgctctgccttaacttcgtagtcttgctccatctgaaccatcttatttcatccatcgtcagtgtctctcagccttcttcaggtctttcctatgcgacttgaacaaagaacccaccttccagctgcggaaaccacacgcccgtatcaacatatatatatatatatccatatacttatcagttatggacgcaaatcttacataaatctcttgaaataataacgtcctgaccttttgatatacgtaaggcactcttaatctaacatctgagatcaaataaaactactactaatactggaccagaccgacaaacaaaaactaacactcttactaaaaacctctactacgtctgtggctatcgattatcaaatagcaacgaataacaacgaataacgaagacgaagcctcatctgaaatatttctcgagtagcaactgatagataagagagtctgaaagataaagaaagacaaagggtaaacatagggcaaaaccgcttctcgagacctctaactgatttcaaaccggaaactaacgcaattatcactggaaaagaaatgagaacagaaagagataaagacatatcgtacacatgatttcgccgttaggcgcaattgccattgactatatcgtcgatataatctgactgtatgttgttctttcttgttggaagagttcaaagctaatgcaagttaggagggaaaacagttagatatggttgctaaagaacaagtcaggtgtgcgcgggttgatggatactcaattccgcattctcaagtaaactctgaatttttccaataaatgcaaccttgtggccttgttttctactgtacatagacatctatctggaagtggtaagtgagtaagtgagtcaggtagggtttgtgttctaaataggaaagtagatgtgttaccgttcaccttctgttttattgaattgaattgaaacggcaggcgctggggttgatttggccgataacggaatgtgtttttggaactatgtagaccagaagcactcaccttccttatggagacttatttagatcagacaccaggttgcttagttagtgaatgcttgttaagctgtttgtatataagggtactatttgagatgatgttgtgtcttgaattgtgtaggtacgctggttcaagtccagtgtaagtagagtactagcgtgggtggtagcagttgtagtatcagcagcaagcagagaagaacgttttcatcaatgagttcatcagaaggaaaggaagctaacgtgttacttattgggtccggtggtgttggtaccattgtagcgtacgggattgactatgtcgggaagagccgtcttgatattgttgttagaagagattacgatcaagttagtaagaacgggtacgatatagattcttgtgattacggtcaaatatccaattggaaaccaactaatatctatcctagtgcagacgctgctgctgaagaggcaaatgcttctggtttgaagtacgatttcattgtcatctgtactaaaaacttaccagatgtgttgaaattagaagacgtcgtggctccattggtgacagatgaatacactaccattgtcttgatgcaaaatgggttcgatttggcaaggccattctttgccaagttcccaaagaacgtcgttgtgtctggtgtgtcccatattggttctcataaccataacggtaaagttaaacaaacccaacaagatagaacgtacattgcatactttgagaatccaaatttggatcacgaaatccaggaacataacacgaaaaggttcatctctatctactccaacgataagaacagttgcgggtactatccaagtgctaaggagaacaggtacatgaaattggtgtacaatgccacgatgaatactgtttgtgcccttactggggtggacactggtaggttggaatactctggtggtctggagaaaatctcgatcccagcgatgcgtgaagtcgttgccgtcgccaaggccgatggtgtggacttgcccgctaattgcatctcaaacgctattcattctgatgacggtgactggtttaccccatcgatggccgttgatgtacaaaaaggtaacccaattgaactggaagtcattgtaggtaacctgttgaccgtagccagagaattgaatgttgaaactccaactttgaacctcctatatgaactgttgaaagtggttcaattccgcttgaaggagaaacaaggccttgtgtctttaccagaaaagagaccaatccacgataaattctggtgctaagtagataacttctatgtattagttacgtactcactcaaaataaccctattacctttagttctattcctctcaccccctctctctatgtcaaagcgtcctgtgggtctgcttcaatttaaatttaaatcacgtgactgctgcttctctttgtccaatcaatgattcatttgggtttattcttcgttggttcagattcgatgaaaggacaagactaacaggaaagagagtcacaattatttgaatcaatcttggtgttgcggtttatccttgctgaagaaactgaaacgcttcattgtaatactgagaccatgttgagatcaactactagacggtttgctgggtttggaggccgtggtttgagaccagcttctactttggcatttgtcgaaacttcaaaagaaggtgccatccttccagcatcattaaacacattgtatgctgctggaaacttgggcaaccaaattgatgctgttcttgtgggttctaaggctaaagaagccgctgccgctttgcagaaacttgatgtgtcttctttgaataagattctggtggttccagaagagagtttggatgacctgttaccagagagagttacaccagtggtttacgatttgctacaaaaaggtgattactctcacttcgtcgttcctgcttcttctgttggtaaaggtttcttaccaagagttggtgctctcttagatctgcaaccgatttgtgatgtcaccaagattttggatccgaacacatttgttagaccaatgtatgcaggaaatattttggcgacagttgaatctcaacagagccagaagttgatttcaatcagatcttctgctttcccagctgttggtgctggttctaacagcgctgctatcgaaaccgttaatgcttccaacacagtgaacggtacggaaatcccacccattaaatgggaaggtgccaacttggtcaagagtgaaagaccagaattaggttctgctacaagaattgtttctggtggtcgtggtttgaagaataaggaaactttcgaagctttggtaacaccattggctgatacattgggtgcggctatcggtgccacaagagctgctgtcgattctggattctgtgataactctctacaaatcggtcaaaccggtaagatcgtagctccagaattatacatcgcacttggtgtttctggtgccattcaacatctcgctggtatcaaagacgccaagactatcgtcgctatcaacaaggaccctgaagctccaattttccaagtagcagattatggtttggtcggagatttgaacgaattagtgcctgaattgactgaaaagttaaaacaataggaccagtcattcgtttgaatgatctccgtacttctttattctgatgttttccgctttcaccccagttcaaagaacttttatcaaatgtaattagaccctgacagtaatatatacgtattaacacctatatataataaatggaatgtttgcatacgtgcatgttataaacgtcatctcaattataaaaaatcatttcaagccgacttaaagacaaccagtaccgtgtttaatttctcacttcttggcattctcttttcgtcttcttactcatcattacgcatgcattccaataaaataattaggatccaaaaataatttgttctaactttggtttaccataatttaatgttgcaaacaggagagaagataagaaataggtttgatgagatcccaaatacaccattacatttcctatatgctcatataatatctgatctaccgtaatctgtttttttggtctttttttatcattttaaaactacttcgtaccgttatctttccgctatcagctcctacatgttgtaacaatggcttttcaagacctgaatgctgttttgctcgataaaaaagggactcctaccgatacctctccgagcaaaaagtatggtactggctcctgcataggtgcagatacatcttttaatgatgtacagagtacaagcactagtactgtggggttgaaatttagcaccgtaagtttccccgaaaatgaacgcgttactttgaaggatacgatcccttactatttgccctgtttctcatggattccaacttattctgtgaagaaatgtatgggtgatttcatcgcaggtttatctttagcatcttttcaaattccgttagcaatgtcctatgcaacgtcagtagcgcatgtccctccattatgcgggttatactctctggtattctctccagcggtttacacagttcttgggtctgttcctcaaatgattgtagggccagagagtgctatttcgttgattttggggcaagcaattgaagcaagactttcagaggacccaaaactgaaggcaattaacatttgtttggtcattacttttatctccggtttagttttacttactggtggattgttgagattaggtttcttggaaaatgttttgagtagggcattgttaaggggattcatcagcggcgtgggtgtcattatggtcatcacgtccttggttgtcgagttgaagttgaatcatgtaacaccaacgaggcaagaacattatcattcaccgtttgaaaaagtattattcattatgaaatatggtcctgaaaattatcataaaccaacagcgatactaagtctcgtcgccttcgtaattctgatgagtctgaggatcttcaagaaaagatatgggaaaaaattcaaatggcttgtcttacttcctgatattcttgtcgttgttgctctttccattttcgtttcatataagatgcaccttaaatcaagatatggaatcgaaatcattaacgatattcctaaggattccatgaaacatttgaagaatcctttttctaatgttaatgtggctactttcaaagatctatttagtactggatttatggtcgccatgctagggttttttgagtcagcaaccgcgtcaaaatctttgggcaccagttacaatttggcaatttcttcaaatagagaattgattgcattgggttcaatgaatgtggttggttccatgtttgccattttgccagcatttggtgggtatggccgttcgaagatcaatgcatacagtggagcacaaaccactatgtctggttttttcatgggtttggttaccttgttcacgatacaatttcttttacctattatcagatacatccctgtatgcatcctttcggtaataacaacagtagttggtctaactcttcttgaggaagcccctcatgatttaaaattccattggagatgtaaaggatacagcgaattaactgtttttactgtgacgttattagctaccttgttttactcgttagaagctggtatttatattgggtgtgcatgttctataatcaacgtgatcaagcactctgccaaatctagaatccaaattttgggtagagttcctggaactgaaacctttatcaatgcagatgattatcaagcaaatgcagcaggttacttcataaatccacagatcgaagaaatcgaagggtttctaatagtgaagattgcagaacctttgactttcaccaacgcagatgatttaaagatgagattgcatcgtttagagaaacatggatctgctgttactcatcctgctgcacctaggtctcgcagaaaagaaatgactgaaaatgtcatatttgatatgaaaggtatgacccacatcgactcctctgctgcccagacattagaggagattttgtccgcatataaccgcagagatgttcacgttttcttgacgaatgttccattgactgagaaggtcagagagagactcgttacctctggagtcgcagagctatgtgaaagaaatacgattacaaactcttcttatttcagcaccattgaagatgcacttactgcagcggatgtcattgcacaaagacacaatcagcaatatcatacaccacctcccagcatattttcaaataccttgttgaactcttcgatggcataaatacggaaacggccaattgtctttctctcttcgtattcatatacgtcgctgatccaccttaagactaactcacaacatattccacttaaaattatttattgcaatttaaaaacttatttatattactacctgacatctttcactacgtcctgcattcttcatgaaggatacatagagttgtgctgttaacacctttccctattcctcggtagtgtgttatgacaacgaatatttgttttttcaagaagtcgctgctttagctcagttgggagagcgtatgactgaagttcataaggtcctgtgttcgatccacagaagcagcatttctttttattttgactagttcaggtagtacctattttttactctatgaattaatttacaacattggtcagttaactttaggacatcgaatgtcaaattgtagttggtagtagtcaattcttgtatttccagttgttctttctttctatgtacatttttaaaacattacgaaagatataaattaatcctgttctcaggcaagcacatggaaatgggaacggcccttggctatgccatcactgacaatcttttcgatttcatctggatctgaagttactttgctcaagcaatcataaccatctttcgtaactagcacgtcatcttcaattctgacaccaccgatgtatagatatttatccattacttcatgatcgacaacttcttttctttcagggaatttatccaagagttcttcaattaggaatggattgaaataacaaccaggttcattagtgactaccataccttcttgcaatggacgacgtaatcttagaaatttcaaatatgggttagcatcttcatagtttggtcttccaccaacgtcatgggtatccatccctaacaaatgccccaagccatgggggaaaaacgccacagtggcctttctatcatagatatcatcagctgagaaagccgatttaaagatacccagcttcaacaagtgcttgatgagaactttatgagcagagagatgaatttcctcccaggaggcaccatctttgatttgtgacatggcattctgatgcatgtccaatactgcatcatagatatcacggtgttctttggtccatttaccactaattgggaaacatctggtaacatctgcggtgtaacattcccattcagcacccgcatcgatcaacacggagtgtttgcctgccatatcagcgtcattatccacatagtgtaaagttgaacaactaggtccactacaacaaattgggtcataaccttgaaacttggaaccttgacgtagggcatggtaagtgaactccgcatggatgtgtccttctgttttctcgataggcaaagccgacatcacagccaaatggcaagtatcagtgacttgacaagctttcctcagcaattcaatctcataccaatctttaatcaatctagactcatcaagagcatagaagagatcctcatcgttagagatgagcttcgatgaaacttgtggatcatggacattatctaaatctgtagtatagataacataatccgagagtttagacttgaatacatttggtacatcgcttgcgtataagacttcatcaacatcgaatttcttagctgcagcttcaacactaattgggagaccgctccacatgatatcgtcttggtcaacatctggcaagaacaaggttaatttctcgttcttcagatcaaataaaaccgaagaccccggaatgttacagccagatagatagtaaaaatatctgttttgtctgaaggtcttcgtctgatcacaatacttgataggctcaatctcacctccagcaacgaaaatagcacacggtgaagagccggtatctagattcttctttttgtcaatgaaatgagatttaaccctcaaacaatgttctttggcaggatatttatgtcccacaagagcagaaatcacgctcgtactgttgttactactcatttgcctagaaatctttccactggtttcaaatacgttggatattgcagagactttagaaacagtattagtcaacttcctccaaacaccgtacatcaacacagaggagcaaccaataaaactagcggattgcttaaaatccatatgatctactgccttgagtatatatatatatgtaacgaaataggttgcaaataagtaaaaagaaagaaaggacaacagcaggatagacagatagatacagtagtagcatgaaaaaaaatgtgtcaaacttcagtcggaattgacaactagtttgacttcaatataacttttggcacatttgaattccttatattgattgttcccccatcccacctcgagattgaaaaaaaagagacggaattccgtttccgtatggcctttccggatatttcaccagattaattgaagtttcaactgatatatcatctcatctcatctcatctcatcttgtaggacaaaagctccgtaaaagaggcaattgaatgataccagctttaggtattgataataccaataaaatttcataatggtatcagttaaacgggaatttggcgaaattattgatagtgatggtgatgttgatcacgattctaacaaggttggaaagatagatgttcaacagaaaagatcggtaccgaaggtataccttgatcagattgatatgaaaaaattagattttgatagagaaaaggtatgttcagttactttatcgcgttctaacgtatactgttgcttatccagtgggaaatatcttcagggtaggggtcaaaattctgttgcctttaaacatgccattgagtcagaccatcatgtgtttttgaacctgaagagtttgaaagtatatgtattgcccgagaattatgaggcagatgtggttccaggatctttgctttcagatatagtatatgctgctagtcccaggtttcataatagccaattacaaacgttccccaaagtttgtcacgatttgaatgacaagaggtatttgaatgggttcgttggtatgaataatttgactccagatggttattccgtagtagtgttgcaagcactggcccatgtgctgccaatccgtgattacttcctgttaggggaaagttccagtggttataatactgatgaaaatgatggtccgggtttaataggctctctgtccttgttaatacggaaactatggagttgtaaactgctacgaaggaatatctcaccccatgaactcttaaactatatatcacttgtttcaaagagaaggtttccggtggatgattctagagatcctcgtagtttcctactatggctgatatcttcactctgtgcgagtaaagaaccttctttggtacggactgttacagatcagttccagggccacgttgaaatcacttcgactccaatagaaactgttgttgatgagaaggggaaaactatgaagtttaagaagttagaagctgccaccactacacaaaagacaaaattctggttactttcattggacttaccacaaatgaaccttttcagcaacggtaacagtgctaacagtgtatctcagacgaaactggaaacacttttacaaaaattcaatggcgaaacagaataccataccaaagattccatcaaaacgtaccgtatattgaagcatcctaaattcctaatacttcatttcaacaggtttgacaaaggcttcacttccattaaagatagaaacaaaactctagtagagttctctgaaaaattagaattcagtggtgtacactataaattactagtaaatatcacccatgattgcgtaatacaaatgaaaatatcggatacagaagatttgttagccagcagatggaaagtacacctcgctgatactttacgcgaccaatggtacgagtttgatgacattgaagtgaataaggttgagaaagagtttcttttccttaaagaatgttacattcaaatatggcaacgcgtttagaaactgctttcgttattcagattatctacactcttggatcgattcatcatttcatcggctaaaacttatctcgcaaattgaagttgatgtatttttactgtatgtaagatggttatttaatagcaacagagttaacacccgctgttaatacagatactatattgtcttccaagagcttttcagcagtctctgcaagatgtctttttggatcctgttttcctacataacgcgttttcaattcttcttcactcaattctctctcttcctcaattctcttagtgaattgttcagcgatcttaatcattttctgagtttcacccaagttgtgctcctctctttccttgaaatcatgcatttttagtcccgattgccattgttccttatgtagattcattaacatgttcatttcggcggaagtcttgtgataatcgatattaagcgagtaataatgcctatttagaccatgaatcaacgcttgaatattcggtttgttgatcaacccgatattagaagtattttgccttggttcctggtttctcatgacagtagaagggtcaattagtctgaatgcatcaatgaccactttacccttcaccgattgaataggatcaacaaccaccgccacagccctgctgtttaattgttcaaatgatttctgagtattcacatctactgaagataaccaacaaccaaaacccggatgtgaatggtaccatccgacaaccatttgatctcttcctgtttgttttaacatatccatcatcttagcttgaaaaacatcatcaacagcctcgacagaaacacctgtacctgactgaggcatggcaaacacatcgacaacgtttactgtataatcatcaacaaattctcccaacataagacccatgacttccattggaacaccagctctcccatgtttcaacatcttcaacaatgcaagagaagaaatgtacacagtttccttggtgtcatcaaggggaacctcggtggcattggcacccatcatgcctgctctttgagacatcatcattctttgtaaactttccatcttttgttgaaggatttgaattgcggagacgataaattggcttttgtatcagcgttctgtttcttgatataatacttccttaataaagtaccaacaaattgaaattcttattctttcctgagaagtatgcaattgtcttgtagatttcaattactgtgtatctaatactgctaataatgacttatggataccacacgtacagagatgagaattcttgacgaattatctgcttatacctttatcaattgtaaactgtttgccactgcattacaaagttacgatctttcttttggcttatggatttagtagtcattattaacgaacatcaccactttctgaccttcagatatttaacctctttcttccctttaaaaatgagatgagactggagtacttctatgcatacatggatatctcatatacaaagcgaagctccatggtctagtacagtcaaatactcgagagcacgacttgttgaagaaaatattccgttttattgacgccgaagattttagaaataggaaacgatttcttacattattcatactttgttcccagtcctttgataagtgaaattacgaaagattatcaagacttagacaggaaaactttacctatcgtcacgctttttttatcagtttgatccatcatcataattaaactttgaaatatttcctaacatatgagtgaaggaccttctgctcttcctgaaggaacgcataccgtcactgttacggaggttccgcagctgcttcaattgcgtgctggccagaatgagaaaaacaaaactaagaagaaggacaccaagtctaaagtaagatgggatgagaaagtaatagataatgagaacatgaacaagaagaaaactaagatttgttgcattttccatcctaataccccattagagagtgatgaagaagaggaaggagagtgcgagcacgatcataatcatggacatgattcatcgtcttcatcatcttcgtcttcttcagacgaggatgagggaaaaagctttgacgaaagaagaaaggcaagactcgaaaggcggagaaaaaagcttgagcaaaaacgtccaccaagtccgaatgcatacgaagtccagccagattacagcgcttatagagataagaacagaaaagacgctcaatgatttaggaatttgatcagcatactctttcacttcttgtacatttcgttgcatcttctactcactacaacaatgcactgctgaaaaggtaattggcagttcaaatgtatatatatacatatgcatatataatctatcaggcaattatatcgaataacaatcgacttacacatggttattttattgtatgctattatggtaggacgtctgggttctgacataactcaggtgctcataaatgagagctctgctacaaaccaacttctatattgattaatatgctgtaagtttctcttggcattttgtattgaatcataccagcataaatcatacaatttttagcaacacgtttgagagaatcgatttgctgctttttagtcaaagattggtaatcactttcgttcaactgctttatgatgttagaaatgcatagcattgtaattatcaacaggttaggtatgttctttaatatattctcatccaaatgtgtaaattcttgtgctctttttctggtcgagctttcatccgtgaacggaattaaatcgagatcttcaatctgttgtagggtgttttgccattggcgtgctaggaatgatgctcttatatcagctagtttcaacaagacaatacatgtttctttgtttcttgcctgaacctttttagagatttcgatgttgttgatgtacacttcgattaacttctttgccattaagacgtaattcgtttcgctgttgtcattcaacctaaagagggattgattgaggtcagtgctacttagaagttctcccaataacttgttgataatggacataacaatgtcatattcttctgataactggtacaacaacaaactatcatgaattcttctttcttcatcagccctacgagcagcctgttcggtaatcttatacaaaaagtccttctggtcctcaagctgtaataatgggcgtctttcttcaactacaccggggatcctaattccttcagagttgatctttccgagaagtatggtgaactctttagtttccaagatcaattccctgagtgcctcatacgcccattcaatctgctctttctcattcactagtgcgatgagaattagatattcgacagctattcttggatcagagtacttgaacgactttgtgtaatttcctaataccttaacaaagtttatccttgtttggccatcattcacggagatcaactcatcctttttataagatgacacatgtaacatgccatttgccgctagaccaattgccaagtgaacagcatcgatttcatttattttgtatgagtactgtactgctagttcatattgtccgcttaacaaaagggcctgtagataatagtttttaaacatgtactcaccgtaagagacaacagtatgttggaaatcgctgagggtatacctttcatatactggatcatccatatccatatcatctttgattaacatcaagtgaatccataaccaatcttccacgcttagagtaatagaagagatattcttccttgtcaaatcacatctgccaataattttgtagaccgccaaacggaacggatcgctgtccaaagtgtttttgatatgctggttatattctgtatgcaaccttgagacaaattcctgtggaagacgatgatcaggagacgttacataagctttgaagtatgttaggaaagattgctccacttttttgaaactcaatttgttgttaacaactacttctagcgcgtcctgcggtaaaccagcccttagcaaataaaaaatcaaggcccatacgggaattccattcacaatcgtaagattgttaaatttccaagtattttcaccagtcttcagtttgaggtcaataaatgctctaattttgttaacattggtcggtaaaccttcgcttggattctttgaatacaaattgtcaacatagctcaagaactggttttctaggtattttttggaaaactcaacaatatttggggattgatttgttgcattatctataatctcccaaccgtcaagtagctgtctatacttcgagtcggtcgtattctgaaagatggcaatgaactctttggttaattgaaaatcgtcattatgtgattgtcttgaattgttaaacctgtaaataattttggcatatttctcaaacttttctctaaggatgtgatttccattgacatttgaatttaaatcaccatccaagataccactaccaggtggtttcccccaaaatattggaccgttgggatccaaaggagccaaattagtcgtatcgtagttagaactatcctgacgtttcttgactaggatcccaaagctttctcttacttcatctttcctttgcttccaatctaggttgaagttctgattaatgaaattatcaaaatccttcgctgctaaagacaatgattgttcaatggaggaaaggatattctcatccttcttaatatgtaaataagtgtccaaatcaccatcgttatagccttgtgcaacccgttgttcggttaacaactctgatgacttaagattcttcaaggaactctcaatttcgtgaaattcaagtccacttcctgctaagagataatgagcttttgtatgattggaatcgtgaggaattgtcttacgcatctcctgtgccctctttttcatctcattgacactcaataagatagctccaaggtcagatgaagtagaaggtaagttctttgacgtttctaaaagctcattgaataatttcgatgagctcttagacgtggagccactagtctttgcatcgttttgaaatgcagatagcattgtatcactgctgatttgactgttgatattcatagttccacgattgtgtggattttacaattccaaaatctgaacgggttaaagataatttgatgcgatggatagcaacaatgtgtattgattttcaaagtatcttcaatgaattatttccatcatctattcaacgtattgatagtttacattttcttttattgttttctgtctaattttttttaactacaatgttttgcaccgttacccgaacatgtgacgggacaaaaaaatggacagccagaaattgatcatgacagtaattaatattaaaacataagtatgtatgtattaactcaagagaaaataagttaattatatattgtaatctggaattgatgattgccagaatcttttgattcctgtggtcagtttttgtagaatagaaaatgttgttttggttaccattgaaatgtaggttttacttcgtttagttcaaaaaaagagttgaatgaaatgaaaaattgattgtggtcgttatacgttgatgatgctgtgcgaaggacaaagcttaatcgcagtacatgttgacatattcatcaacagttaagtttaagaaaccgtcatctgtacttgcttccattaaagcttccaccttttcaatatcgccggcgaaatgttcacgcaaatggtggtagaatttctgcatcaatagtgggacaccttcctttcttcttagtctgtgaccgattggatattctacgaccacttcatctaagacagtcccatcattcaattctactaacaaagcgtttgggattgatctctttgatggatcatgataatccaaagtgaattggtcatctttagtacaatacatcttagctctcaattcgtcaatttcagggttgcttgctacttcatcactgtaatcgtcagccgttagtctaccgtaaattaatggaatagcagtcatgtattgaatacaatgatctctgtcagcataattgtacaatggaccctccttgtcaataattctcacagcggcttcttgagttctaattctgacctttttaatgtctttgtaagttttgcccaactctgccaactgtttattcaccttaatagctgcttccactgccgtttgagcatggaattctgctgggaacgatatcttgaaaagaacgttttccatcacataagaaccgaaagtgtccctttgctggaaggtgaatggtttacctttgaaaagaacgtcataaaaaccccatgtcttagcggttagtacggaaggaattgtacctggacttccattcttcaccaaatatgcaatgttgacagctcttgccactgcgtcaccggcagcccaagatttcctggaaccagtatttggagcatgcctataagttcttaaagcttgtccatctacaaaagcatgagataaagcttctgtggtctgagcttctgatagacccaacatcttggaaaccacagcagtggtagcaactttgaccaaaacaacgtggtccaatcctaccttattaaaggaattctccaaggcaataataccttgaatctcatgtgctttgatcatagcttctaacacatctttcacggtgaataatcttccctcatcacctccggtggcctttgacaatctagttaaatgatctgccacggcaagaataccacctaaattatcagagggatgtccccactctgcagctaaccaacaatcattgaaatccaaccaacgaattaaagttccgatagcaaacgcacctttcacagggtccattctatatttagtacccaacactttggtaccgttaggtacaatcgtgccaggcacaattggcttgataaggtttttaggttgatcatatttcaaagcagccaaaccacaacctaatgtgtccaataaacagagccttgcagtttcataggcttctggagaagtgatacctttattgtgaacataagaagaaatttttcttaatacttcatctgcttctggtctcttattatcgatgttaatggcttcctgagaatagtaatttttcatactattcaattgagttgcaataccgttattaacgaatgtcgttggcctcttgtatgataatctggctatattgttaacacttgatctagctgattgacgtagcattgttaacttaattttgtttgaacttctttctatactacttctctaatcaaaatgtcaattaaatatcagctaaaccaaatattgacaaagacctaaaaacaattcttctatcaatcaaatatcaaggatttaatagctctcttatataatttgcccaagccttcagctcatttatttgttaattgtgacagctctatactgttcacagggttacccaaaaagctatcgatgaccaagcctaattgagtgtggaaaaaaagttggtctccattaacttacctgtgtcaacccttttttccaatgagatgagaaagaggggtataatgcgatgatcgatcgaaggatgtgcgggtaccatccatgaatcaacttcattaatcaatcaaaccatactcaaaaccctaccctctctttaaaaaacaaacaatcagccttccctcaatatacactatttcacggagtaaggaattacacctgatgaccttgttttgttctttgattccctagttttcttttacctgattctcttaaaacgatagtattcggtgaactgcaagtactaacagaatatggaacaaatacatacatacatacatacatacctacgcccttactcatcatgttaactttgcctccattttttgtagccgttttcgcagttattaatcaagtcattctttcatgggttaatcactgtcccttaaaatcttgttttcttctaatgtcggacccgtaaccgttcgatcgacacttgttcttaaggggaagaaagtgtcaaatccaattccaactcggtatccggggttcttttctacctcacaataagcttgtgctgatttttgtgtaagtttatctgatagagtgatacataattcaagaagctttatcgtacaggccggttcggttactaattgttgggaaacgtatgaaagtatgtatggttatgtttctatctgttattgcgggttgctaacaaggtgaagaaaaaaatgacattatcctatttgagtaaaaaaatgtggggtaacgacggatgacagatgacaagacaggtgacagaaagtaggacgacggagctgcagcggatgtccatctttttcaattcggtgtgatcaccggttggggttgagtagaacgggacacgtcagattgggacatgtgaatagccttacatcacgtgatcgaggtgagaagttcaatggcatcgttatttcgaattgttatgtattttggtgaatatagccgaatacgtaaataggttaattacatcttcctttgtcatgtcataagttatcatcagtagtaaaattaatggttacaaactcttgttcgtttcatttatatttaaattttgcatattttttttatggtgtttagatcgatgctctttggtctttcaattggtaaaccaaggattctgtcccaaaccaactgtgacaagggtcccattgcccttgaacaaccgaatattactgtgaaaaatagtagctgatcaataccgtagtggtagaataaaattcctgatgcgctgtcgacgtttggatatggattctttgttttaccatgttctttcaagacttttggtgcaatttgtgataattgtttcatcaattggactttggcatcagatttgaattcttttggtctcttttctgcaaaattcaacattgcatcaaatcttggatctggtttccttaacacggcgtggccgtatcctggaatcactctacttgaattcaatactttccatagatattcttccacttgtttcacattttctacagaatcgacatccttttccatctcaactaggaatctaaccacttcttgagccgctaatccatgcaacggtcctgccaaacccatgataccagaagaataactgaggtatgggtcacttaaggcactcccgacaaggtgcgtggtatgtgcagaaacgttcccaccttcatgatcaacatgaataccgcagtataaacgaactaggttaacgaagtcgttagatctttcttgtgtgagcgagtgcatgttcacggaatcactaactgtcattccaagcaaagatgcaatgttgtacgaccaatccttttcgacgttgtaatggcctaaaggttcaccatcgttaacaatattgctgtaaattttcccggtgatcttgggtaaagcggcaattagattcaacacgtcttcatagacgtattcccaataatccattttcccaatgctaccttcttgatacttctcagcgaatatggatcccttgttcatggatgccaatgcaattgccaattgggtcataggatgcatgtcacgaggcaagctcgttaatagcttctccgtgtgaggtggtaacttggcacctctttcagccaattcttgagtcaattttcttacctgttcctctgaaggtacctccccagtcatcaataaccataacatggattctggtaagaattcacctttcccattatcttctggcgcgccaggtaacaacttttgacattcagcaatagttttcccatggaaccttattccttcattggggtccaatgtggtactttcccaatacatagattgatttcctctcataccattgataacgctgccaatagtaatgtcaccaactttcacatccgaaaagttcttcttgatatgtagtaattcttctcttctttttggtataacgtcagcaattgcagctttcaaattcaatagatgtctactagaatgaaacaatctagtttgcgtaaagtttttgagcatcatgccgaaaataattgataatataaataatgtgccttgaggattgttcctgagtcagccttgttattatttcgaaatattcaaatatacataaaataagggaagacgtcagtgcaaaactgaagtccatatttcaaaattcgataagatctataattaccatcatttatatactttataaatcgtgataatgaagtggtttacgcggtaatcagttgctaattaatcgatctattgatctattcggcaccgaaagaggtgtaactctcatacgttatattatgacctttaaaatgttattgaatgtggagaaggttaaaatgatgacagttttgtaaattaaatacaactagttgacaaaaaaaaaaagaataaaccgacgatcattgcatttggaacgggttaaattgacgacccttttgtctcctccttgttaatcacatgccaaactctgaagggatgagtttttgaccgttgctttaccagaatactagatgaactcagaatagttaagtcacgtaaaaaaaaatggtgcttgtgtttaccagctgaaagcatcttgtcaataacggtatctggcagagcagcgtcagttttctttttttttttttttatcatctggcttcagaatcgtaagaatgtcccacttttcaatctgcattgtatggaagtccccaacaacgttgaaatgtctctgttctctcatcatcaacaatgactagaaaatagaagaccgacatggcagccggatacacacatgcgccctcatatccgaatctttgaacagctgctgacaccaaaattgtgttgaggctgaaacgctgattaactccagttgttacagtaacggtaatctaatgtttttaatatgtttagtcacatgatcgatgctaaaaggttatcgattcctccatttacatacacacatatgcatatataaattgatgtattaactatgcaaagctgacagatttcttcttcttgataggttcagactgagctgctaatgtctcttgtttcagttcttgccttttggttttcctacgaatagttctggcaacggatgccttcttcttgatttcatctttcttaccctctagttgttccttcttttcggtttcttttctttccatttcttgtctctttagatcacgaatttcttcgagtctccttgtcttctctaatttgctctctgttatttcatcatttttatcacctatcgttttgattaatctgtttaacgctattaaatcatgatcaccgatgaacttcttcccctttttaccctttttgatttttacaccaggtacaatcgctctattaagtgttggaatatttaattctttctcggtatagcgtctttccttcttcttctggctaccatatagacgtgctttgaaattatccttcttcacctgtaacttggttggtttcttggtatcagatttttcagtcattttaggcacgtttgccatttgatttttggcaatagagtcctcgaatacttctgatcttacttccctcgttccattttgtttcttggatctcttagccgtttttgattgtttgggagccatctttcaagttcgatggattgttatgcgtcaaggatttttcttctataagtctgattattgtaaattcagacttgtctcgcggtttaactagtagacagcgtacccagaggtataaattcaagtccagttgtgcttttgtagtagttgtgatagtgttctaccaaagcgatgagatgagctcaattcatcatcgaaaagttttatttttatttcttttcgcttggtaacactttatttcttgaattcctgcatgtcaatgtgaaaaaatagaataaacaattaaaataaaatagaataaattaaattagataaaaaaatataaaaaaatataataatgatagaaaatgaataaatgatcagaaacaataagatgatacagagtacacaactcacgactagtataaggtaatataggtacactgtgctggagtttaaatgtcagatatccgaatgatattagtttttctttcaattgtctttttaagtatagtaataataatgataatccatatagttatgttgtatattaaacaagacagtagtgaacaaagtgatgtatatatatcacgtgcaaataaaatataatttcaaattagttttaattcttcttttatttttctagagaaaatatctattaattttctcataatagaaataaataaatttttactttttttataattatctatttaatttaaataaaacttaattcaatttattttaaaatattgtatagttttactattccgaaaaataaatatattttctgtttcaataggaaattaataataaatattaaaaaattaagccgggaagaaggtagtggagatgttattgtatggagttgtgagagaacttctaaggtgtcatttttttttcagaagcagtaaatatactactggagccgctatgaactaggatctatacgatagcatattgttattgatcaacaaatcccgaaaatatataaatagagttttcttcatcgaattcttccattcgaatttgacgatatatctatcattgttctacatttatatgtatgttagacggcatataccaagaagaatatcgaagaagaaccaaagaacatcataaatagtttacataacacatgcgaagctcttaattaaatccccaggttatcgtccagaaagtacagaaaaacccgatcaggagatcgaaatgtccatcatcaacttttacatcactatccctctagaccaagtccctaatgtcactacttcacagtatcctgttcaataagagacagtaccatattctcaaaacttgctatttttcaatttaatcgcggttaatacattaccagtagtacagatttggtttatcaatatcaggcctaacttattcttcttataatgaagaaagctcttaaagtaaaatagcagtagacaattcttgccgctaaggcgctagtaatccacgacatcgtggtcgaaactcaagataatccaaaaaggactaactatctttgatttctatttatctaaatgagaaaagaattctcgcatgttaatttgacaattcatgaagttgaagtaataagtcttagttaccagcttgtttgacaagtgaaccatccaaagaagacattacgacgttttatgctttgagtcttttgtcagattcaccttgcgagtcagaaaatgtcctttttctgatagctactttagagagaatacgattgtaatcttcggttagggattggaaagccgtttgtaatttatctttcttcaggctctcatccatatccataagagcctcaaaattcttttcataaattctcttttttaattgtaatctatagttaggagacttttgatatagaaggaacatttctaagatacgcatgaactgtctcttctccaattttaactgagcttgcttcttggtaatccaatctatatttataggtagttcattcggacaatctgccaaagagtttttgttaatcactctttcaaaatcacaacgatctctcaaatcgtcgaagctttcattcggatcctccactgttatctcaacgacagataagtcattcatccattgttttactatagcctgatatagcctttttccatgaccatgaccttggtatggaggcatgattaaaaattgggatatttttgccctgcatttctgttcatctgctttgctggaatcaaacgattgagcacctaaatatttccagaactgataagtggtggtgtacccaatacacttcttagagtttttattgaatacaatgaatatttcccaagatgaatcattttcgtcaatgtatgaggccgactctatgaacaataacgtgaaaatctgcattcttttatgcaacattttgatagctgggtcctgcaaagaaactctatatatgacaaattcttgatcaccgatttcatattcctcaactagtttgtctttttcaggtaaagcaaaagtctcttgctccttggtgaacgtttttatccatgcttcctcatctttaataattacatcgtcttctggaagcttatcaagaagtagcttctgtacatcttcaatttcgttattgagtttcgcatcatatttgacattaacaaatggtttgaacgtgatagaatcgaacgctaagaagatctgtaagtttttatacccaaatatttgttcagaatcaccataaataggatacgtgaaggttggcttgaagttaactgccccattttcatcaactaaggagagattaagggcttcattagaagatacagtccatgtttcaggtcttaaatcaacagccatattttcagagagtcaatgcttctcagttgagtacagctttccctgttcctattattgctttcgcgtctcttgattataatctggcattttatttcagcttttttctttatttccttcataatttaagaaggtaaagcttgaccacttcataatggtagagtagttgggcatagaggcaaagcaattaaaatagatatataatcaaacctcgtgtcaactgttgattactatgttccagaatttatttggattactttaggtatatttccagtgaaatctgctacgatatagagtaaacgtctgacataaattggtagatttttgacggttgccatgaagaaattcggtgttgcggccttcggcgagtctggtcaatatgatcttgcctcgaacaagttaggctcacagaataatgaattgaatgagcagctttcaatctttcaagttaaactagtggaatttgccaggcaacataataaagagctccgagatgttccccgttttcgtgcgaagtttatgagaatgtgctcagcgataggcattgatccattatctatattcgataagaatagccatttattccatatagatgacttctactatcagatatgcgtgaagattatagagatttgccggaacacaaaggatgtcaacggtggtgttatatctttagaagagttgcatgtcaattatttcaagaacatgaacatagaaatggaggacattgaaaaggccattataatgttgggacccctagacggtggctttgagttgtttactataagacagaaaaagttcttacgtagtgtgccaaatgaacttacggatgaccagactaaaattcttgaaatatgttctatcatgggatatgccagtataactcttcttagagccaacctcaactggaaaagagtaagaagtcagtcagttttggatggaatggtggcatctggactaatttgggttgactcacagtctctggaaggagaagtgttgtactgggatccgtcttggatcatcaacttaagctgactcgattgaaatcttaccagtacatcttagtatttgcggaatagaacattaagattactttgaaattactgtgaactatataaaatttacatccttttatttttattactattgttcattttggattacgtgttttacgttccctgtattttgcgtttactgtttcaaaagaatccatcaggttacgatcagacattttttgataaacattaacaactttcccgataccatcgcccacatttataacagttttattcttaatagtggctcttggtagattatccttgaatattttggccactgaagcctttaatctatagttcaattctacagaatttacaaccgacgaggagcgcgatgccttatcagtcgtttgatcaggtactatccactccatcggcgaaaactcacattcgtaaagaattagaggaatatcgctagccatttcgtaaattggttttctgggcatcttttctatatccaacatttctttgattagattgggatcttcaagaccttggccaacgagaaatagattagccaccatacacctcacttgatgccacaagaaagctgaacctaccaagtcaaagcagtacatgtcttcgctgacgtgcatgatatttgaacttttaattgtcctcttataatttgtaatctgttttgaaccatctaatttgcaaaagtttctgaaatcatgctcaccttcatagtgtttggctgccagttgcatcctttcaagatccaaaccctctgagctgaacaagtatttgtaatgtcgacttttacagctgaatctggcatcaaaaccttttggtggccgtaggcaaactgcagatactctgatatcttctggtaaaatctggtttaaaatattaacatattgaatctccttgtcgtcatagctgggatcaagctgctcttctgcagtgagattcgaacgaactctcaatgaaattacttgattcatggcactaacgcctctgtctgttcttccacatctactaaacttatattcttgaggaaccatggacggaacaagtttgcatttattcatggtctctaatatcgtaccctcgacagtaggtaaaggagtcgcatctttttgaattgccaatccgttatagttccatcccaaataagcaaacttgaaggcgacaaaccgtgtgttgtatttggagaagtcgaattcccttgatttcctaggtttcttgacgttctttcttctctctgcttcaacagcagcgtccgcagatcgcttttttacctcagccacggtatctgagttatttcctttagcatcactaccattttcactagtattttccagctgtagcaatcgctcaatcaactgttccctggtccaattcttataagcagactggtcagtggacattgctgacacagtgcctttaccatctagtttgaaaagttttgataaaaatcccatcccagtatatgtagtcttgaaagaattatatcacaaggctaatataacttcatagaagtttaacaaatagatcatatcaaacaaatttgaatacaaattgttatgaatggaacaaccatcgagaacaacgccgcatcaatgccaatcagcattaaatgcaagtttgtacagatttaatggaattttttttcttttctattgggatggcagctggaaagaaaaaaaataagttcaagctcatctcatctcatcgggaaaatgtatccagattaaatcagtgtgaacatatgcatacatttgaaatccaggagtaagatttgaccaacaaggtataaactcaccactccaaagcctagtctaaagtttcgaactgatacaaaatgtcgaagtcgttatcgtgggacgatttgaaatgcgagatacaaccatggattagaacggctatagaatcgatggggtttgagaccatgacgccagttcaagcctcaactattccgttgttctctggtaacaaggatgtcgtggtagaatctgttacaggatctggtaagactatagcgttcgtgattccaattttagaaaggttgataaaagaagaagccaattcggccaaattcaagaaatcacatttccattcgttaatcatttcaccaaccagggaattagccagtcagattcatgatgtgatagaagactttctgaagtattatccagataatctgtacccaatacggtcgcaattactcgtcggaacaagtagcgctagtgttcgagacgatatcaatagttttacagataacagaccccaaatactagttggtactcctgggagagtcctagattttttgcagaagactaatgtaaagactgcttcctgtggtaccgtcgtgttagatgaagctgataagttattggatttgaatttccagaaagatgtagaaaccattttaaagatgttgccgaagcaaagaagaacagggttgttttcggcaacaatcgaaagtgcgggtgcgcaaatcttcaaaacaggtatgagaaatccagtgaaagttgctgtgaagtctaactcgagcgcaccttcatctctttcgataaactatatcgtcattccacctaaggataaattacaactattgttgactctactcaacaactacagattcaagaaatgcatagtttacttcccgacatgtatctcggtcacatatttttacgcattcataaaccatttgaaagagcttaatttgattcaggatgatctaaaactcttctcactacacggaaagctacagacgcaatcgagaatgaagacgcttgacagtttcacttctaacttgaccgatgccgtactattcaccacagatgttgctgctagagggatagacataccagatgttgatctagttatccaacttgatccaccaacagatgcagatatattcattcacagatgtggtagaacaggtagggctaataggattggtaaggcacttgtgtttttaaatgaaggtagagaagaagattacgtaccattcctggaagtgaaaaacgtcaaactagaagaagaatctgtggaactgaaaggcgtagagaatctaaccaaaatattccacgattggattttacacgatagagcaagattcgatcacagcgtaagagcatacgttgcatttataaaatactactcaaagcatactgcatcatcgatcttcagattccactccatggatttcatcggcgttgcgaacttttacgggttgttacgtctgccacgtatgcccgaaataaccaggtatgctgccgaccaaattccggaggaaggttggttggtatcaccaccagtgaatttagacacatttgcttacttagataaacaaaaggagaaggcgaggttacaagaattacaaaacctcaagcaaataagcgataaaaagaaactgaaaagtgagctaaagaagaagaacatggcatggtccgataagacactaactaaagaagccaaagctgaaagaagagcagctatggccatcaagaggaaggcaattgaagagaaacttctgcggggcgatgaggaatcagaagatgaagttgagcaagactggaaagaccttgtaagacaaaacaagaaaaagaagcataactccatgcaaggaagtttcgatgatttatagtcaattacatatcgtagataaatctattataatataaatgtgcttgtttcattcgagtccccgtcatataacaatgtgttttcaaccggtacatattgatgtgtcaataatttcacgcattcttgtgataccattgcaccaagaattgatgccatcgcagggctgacaaacgttgtatcatgtctatcgttttgtagcgatagcaacttattgaacttcggtttttcacttatagttctagttgccgatgagaggctacccattttaattgcatccaaatgttttaagttctcgagcattttatctatgagtggttcaggtatcaaactataattctcctttgctagaatgcgcatgatttctgatttatccttggcagctttacgttgatatactgctttctgcgcgttgaatagtttagttgaggattccatatctggaatgaatgcggacacaggtaaatcgcctctcaaatcgtaaaatattctgatgcatcgtacaaattggtatacccatcgattaattgtagaattaggttcagcatgaaaactattcaagatgttggtcaaattgtgaggaaatggtcctgattgatcgtataacaggaatgaggacctctctgcttccacaaagttcaaatcattggtcaagggtccagagagtatagaatcgtgaagttcgatgaactctgccctcactgattttctattgataggaatattctttgactttaatgattttcccacattgtacagtagaacggaataaggcaaggaggatacctcttcctgtgacatattttttacatcgaatgattcgtgatattctgctagttcaggccacatacgattgagtcttaaatcgaaagtgaaatgtccatgagaatcaatgacacaatgaggttcactgcctataagacgaacaaatcccaagttatcgttggtggatgccattatcagaggaactgctgagagtttcatgacacgttgtaacaacggaccagccgtgcacaaacatatgacaatagagaaagagttccataacttatgttgtgaatcaattggaactgcattctcgttccaaatatggaacgtaacatctggattcatactttctaacgcatcaaaacctaaaatatccgagtttgacttgttcacaaaatctgatccattagacgagccaaaaactacagtaatctcatgaatacccatgagagccaaactcttgacacattctcgcatcaacaatgtctgattatcgtctacaacgcacacatgagactgagaaagtaaatcctggcctgaatggccccagatcatcaactgtcgatcataacggtcatccaaaccaccatttatctgatcagccataacctgtaccaacgcccttggtccttgatctttaacactagttctaatgcaagagagcccgccttgattggaatcaaatgacgtatttatcatgagatgagcttaaaagttcaagcgaatcagttggattaccaaagttcaagctagatcaactgcataccgttacccggacgagtacttcagcattaccctaaaacttcataagagactctaaagagccaacataaggccggcaatacactgttagttcgtcatttcctggccctgtttttgctacggctatatcataaaccaacaccaccatcaccagacaaagcggaagcaggaagtactataatatcatccacctacatacgattctttccagtctcgaatgataagccgaaaagaagagtcgaacaaaagtttctgaagaaaccaacatagagaaccgtgcccgcaatttgcaaagaagagaaaaattgcgtggctcatgccatgtcaatgtccctagagaaagtaagtgtgggtcatgttctgtttctctttctctttctatgcattttttttttttatttgggaataactgaaaagggcaataggcagtaaaaaaataatcagagtttcttggcctgggacagaaccttttttgctatctacatataactttcctctatataaagtaattgattatctttctacctgtcttgttttctgacggattaattttaggggtcttacgcaggtatatcaagtaaacttcgatacatagtttaatctagttgaatcgaaattttttttgggccaatttactcttctagtgctgcttttagattaagaaataggggaaacagaaaatattcgatatcaagaagttaaattaaataccgatactagtctccaaaaatgcacagaacttactctttgagaaataagaaggctcctacagcttcagagctccaaactccagctccaccacaatctactaccaagtctaagttttttggtaagggttcttttgcctccagtatcagaaagaatactgctggtcagttcggcccattgttatctagaaagctatcctctttaattaagaccgaaaagggttacttgagagctttagaagttgttgctagtgaacgtcgtgttgctgctaaacaattgtctctatggggttctgaaaatgacgatgacgtgtctgacgtgactgacaagctaggcgttcttatctatgaactggctgaattgcaagaccaattcattgacaagtatgaccaatacagaattactttgaaatctatcagaaacattgaagcttctgtgcaaccatcaagagaccgtaagcaaaagattactgatgagattgctcacttgaagtacaaggaccctcaatccaccaagatcccagttttggagcaagaattggttcgtgctgaagccgaatcgttggttgctgaagcccaattgtctaacattaccagagaaagattaaaggctgctttcaattatcaattcgactctgtgagagaattagctgagaaattcgcattaatcgctggttacggtaaggccttactagaactattggacgattctccagtgactcctggagaagctagagccgcttacgatggttacgaagcttcaagacaaatcatcatggatgccgaatcagctttggaatcctggaccttggatgtcgctgctatcaagccaactttgtccttccaccaaacagtcgatgatgtttacgtcgatgaagatggcgaggaaggtgaagccttagctgctgaagaagagtgggctggtgaacatgaaggtggccaagaagaagaagctgttgagactactgaagttaaataagctctcgcgatcacatgcgttagtttattttaccaatgccgctacactcacttctttaaaaatgtatgtggctagcgtatattggaatgatttattgtagaatcaaatactcgttcctgccgtgtacgtgccctctttaacttttaaaaatgaatttttccagagagctcgcaatgttactgtgtgacaggtaaaacggtagtatgtgaagtccgttataccattgctactctcatattctatgtaataaaacatttctatatctcttttaagtaacactaacttctaatatcgtgctgagttaataacagccattggaattcggtcgtaatatcgatcaatctgttttgaattttcctgctggcttctctaggtatgaataaaaacggccaataaatcacaggaaataacactcgaaaagtctttggatttagtggaaagttcgagctagcaaggataagatacggaacaacgtgataattgattcaagtatcctttttagaaacataagtatattcattttaaaagaagcagtcagttaaagtcttaataagttaagttaaaacaatttacatagcatgaaaaaattgaaggagcttcatttaccaggttttgaaccaattgggtaataatttgggtcattcaaatatttcaaatcctcgactggtctttctgccaatggagtcacacggacatggtgtcttgtagattcagaagcatcgaaatcatatacaccagcatgatacaatctacgattatcccatacaactacagtgcccggcttccaattagccctaacttgagcatcatgagcattatcgataacctgatacaaaaatgctagaagagcatctgattcaggtttctttagttcgacaatttttctggtgaacactttgttgatgttaaggactttcttcttcaaaactggatggactcttaccacaggatggataacgtcatagatttcatgtcttgaaatgcgcttggtaggatcaggagaaaaggcatcgccgtttggtggtaacgcgtgaacggcatgtaatccactcaaatattcttgcaaggatggcgacaatctatcaaagatttcaatcgcatcaccaaacaaggtatcaccgccagattgaggagcatcaagcactgcaaaaaaggtataaccggatggctgtaattcaaatgtgatgtctgtgtggaaatacacagaggtcaaagtttgttcgaaaaatttgtcatagtcttctgttttcacatttttgtaaaccacatgaatataaggatgaccctctggagctggggaagcgtgatgaacgtgcaattcaccaaaatacttcccatactcttcaatgtatccaggacctctatcgacaaagtcttgatctctaaaaataagaacacctctttcagcagtcaaaagagctagctcatccttgccagcattatccaactcactaagttgaaggcccctaatttcagaccccagttttggagtaataggactgatttcaacaccacttgtcaacaaatggggaaactttggattagctttcaatgcaggatcctcatacttaacgaaagaatgtggagggaatttctcattaggatcccagcttggtagataatctttgtatttagcttgttttttttccttagcggatgttctaacgacaccgtcatcgtcagcgttcaattcggcggtgataattcctttgttggctctccaactttctaaggttgatacaggcatcgtgttctgtagttgtattgaccttcagtattgatctttcgtctttttactgatgtgaagaaacggtgcccagaaaaagaagctcaatcccatcttcttatatacatatcattttgatgtcatgtagtgcaacaagtacacttatgaacgttcctgatgtatgatacgaataaaggctcgctctcctctcgaccggaatttatgcggacggagtcatcctaagtcacggaaagtctaataatgactaacgtcagccgttcagacgtgcattcggcataaagggctgaaaatgcgaccaatacacttaagataatatcacgttataattcatcaaatacagtgagaaaacaatgtcagagctcgatcgtttttcctctacgactttttttcacccgtcaatgacttaggaatagtttgttgatttgaaatatcaatgtctttactgaaagataggaaaagacacgacaatttctctatatctccagattctatcacttgtggccacacaaagaacttcctagccttcttctgaacctggctaccataacctggtgaactggagttaaagttccaatagtgatgcaggatatcgatttttgagtcacgtgttattcacagcaacagcgaaaggacatgcataacaatgtactagtgggtgtttttacagggtttggctgatagtcagacgaagtctaatttgttccgttatatggactatgatttttactgtgaaacctcaagtacgaacgtatacctattcatcaatgttaatgtgcgattgagccgttaacagaactttggtgataagtgtagatacatttacgaaaacattttccatgtcatttccgtgtgttaacactttgttcatatgggtgaatcacttatggcttctgtctgggtactagacattatttccttattcacacaaaatctagctgtttagagtagatggtttgatatgggcaaatattattgttttatgctttaaattttacgtatttcaaaagaaaatcgatgtatagaaaaacagagtgcacaccactcgcgcagcttataacaacatattggatgtctgtttgagacttttaagcgtggtattaacaggttaacttcaagctttctgatgtcactgaaaatggctcatgatcgataatttgcttggagagccccaataggattcttctcaaatccgcatacaacagaattgtaagttgaattatatatcaaattatgttctcacttaacccattggttctggaatataactgatctgatttatacaagctctatacgagtatgaattctgtagttctcattggcattaccctatcagtaatttcaatctaatcgtatagtatacactggcctgtaacataagggtaaggtactgtttcagcaatttgccccccggacttaaaaagatcacttccaaaaagcccatatccttagggattacacatttaactactgaaatgaattctcaaagctttgaattagtttagttagatattctattaaatatctgacatttgtcaaatagttggttaatactcagggcagctaatatcacgtgaattaaccattaacaatgtgtactgtgctatatcgtaactcaatgctgcatcaaagaacagacagatttatacggtgaacgtttttgggaattgaggatatggaactagaggtttgtatcataagccacctctgacattagcatttgatgatccgtaaaagcgaatactgagctagtagctgggttttgaaattatggcttacagcataagttacatgctgagcttccttcgagtgttcaaagttggctgtcaacacagttaaggtggtgctgcaatcgttttggctgtaattggcgagaaagcggctgcaaaaactaaaaaagaatcaaattgtatttcgcgtcataggtcgtccgaaaaagtcactactgtgataaatgagacagaatgtactgggtagtctatctttgtttatttcaaaacagagaagctacatatgtctgttaaattatcaaactatcaatagacggaaaaagacataaaactgacattcggtaaattttaataatgagatatgaagccacttatttgttcactaatcggtattgatggcttagcaagtgttatgatagaatatccataaagctatactgcgaatgatcaatagttggtaaaatacgatatctatctcatatgtattttttgaaagcattatgtgtccgtataaaacattgaaacctgtagatatgtatgtaaattctttcgctcaaaatgaataatgccgatgattcgacatctatgcatccgtgcggcaggcctcgaatatgaaagatgaaatagacgttatttcttgcgcttcttttcttttatttacaactgcttggttttgatccaacttatctgcaccaacttgcatatttttgccgacgcagaaaaccttgcagaaaactattctgaaacttctttcaaaccagttgtgatgagaaacatagcattcaggcacattaaaaacccgtcaaggaaggtgactgaaaataacagattcccacaattatgttccaaaaacgcagacaataaatagcgggttgggtgcataattctcatcactggtcatcttaataggcttaggatggaccgaaagcttgaaagtcaatagggcttttgttttgtgtctactgtgaaatatcaatataaatatggggttcaggtgagtctatgatctattgaattctcgatggatttttttttacctttctctgttcttttctagtctcttgtttactaccaatcatactgttttgagttcagtgaattgactcaacagaacgactcaataccccaatggagtgtaaataaaaataaggaattagagaaaagttcttcatgggaatgatgaagcggtctacataggacacataaattagaagtttatagatacaaaaaacgaagggaagtataaacataaaaagagaaacaaaaaaagactggacatcaattcctttctaagttatcaatgtctacgcctcaatttcttaatacgagaagagatccattctgagattggatcctcaccctcagtttcgacacattcaccttcattcaattgttggccaaattcattgactaatttcgggtctctaatacagaaagtcaagatcagcatgggcacacagaagactaaaccaacaagaacttcgtacctttggacgtgttcgtaagcttcaaccatagcggccctaattggagtaccccattcataatccagaatgaaatccaatggggaatcgtaggcaacagcggctagatccgcgtctcctcccaaattctttagcaaacgtgggtacagcaaattggtccagatagcaccagaaacggaagagccaacagcaccaccaatactaaaaatggtcatcaacaatgcggtaacggtagccatatgttcgtgggaagtgacggactgagccgttgtgactgggtaatcgtacatacagcttgcaacgccccagacaaccatggcaccaatgacaccagcagcagagccaataccacctctgtaacggaaaaacagacccatgacgacgaaatacaagcaggctccaaagatcatgtaaagctttagtcttctagttctagcaaccatgaaaccaaagactggagagtagatacccgcgacgaaactgtacaagttcataattcttgttgcagaaagatcagtttgattcataccgaccaaaagaattgtgtaaaggtaaccagctgccattacataaacgaaacagaccaagaacatcatccacattggagcccaaataccacggtccttcaacaacttgaatggagcaaatggagccttagcccattgactttcccagtaaatggtgacaggaacaaggaaaaccccaagaactaacggtccgatgatcttaccagttttccattcgttctcaataccaccagcaattgtcaatggaacaaggatgcaacccatagatgctgttaacaagagtaaaccaatgatatcaagtttccaaaacaattggaccaaagtttgaatgagaccatgggtttgatagaaagtcttttcttgtttcaattccatccactctggagtcttgcttgccttctacctcatatgaagtacacaaacgattaatgggatacaacttaaggggaagatgaatgcccacattgcaatgttccaagaccaattttccaatgggttggctacctcgacgatgttaccggaaacccacatgttaatgatagctggccaagcaggaacaaagttgtacaacactctccatctcaacgaagagttatcggacaagaacaaagtaacttgaagcattacaccaacaagtcccacgttatagaaaacggacccggcgcaatatttctgaatatcatacgcttgcgattgaatcacggtaccaacaacgtaaaacacaatggcaacgatcattaaactcaatctaccaaacacgtcggacaaaccagcaaagaaaagttgtgcaactgctgaaatcatcatgttcacaataccaatggtagttaaaagagaatgcgtatcataatcatttgctgcataagtcatataaatatctctgatactactgtccaaagaataaccatacgaacaaataaaggcggacaataagaatatagtctggtagaaccacgtatcatactgcctggccatgatttcagccttacgaatgacaagagacttggtagccaacaacttatcgacattcccgaaatcattaagcttttcaggcgtcaagctctcatctactgcaacctctttttcatcgttgttgaagcctttattgatgttttcatccttcacagtaatactgctttcttcagcaaccgacattgtgtgttaatgcctgttcctgtttacctcagtaagattaatatacataatataccatccccggaaaaaagaggacagagattcccaatgaaaatgaattctatgcaaccattatatacaatacgaagatcgaagatcagaataagacttgtcatgtgtaagagaattacaacgttcttcacacagactaaatccaaggggagaaagaaaagtattgtgaaaaatatcaaaaacttgggtgtcaaatttgtttctttaaagtgctgaagcgatgagatgagatatagaacagaactgacatggctagcagcaataataaacactagagaatggcagctcttccgattccttaccctaagaaaaaaaaaaaaatctgtttcactaaaggtttcgagcctgttttcttataaccactcagataacagagtaggagtcgacccaattttgtttctaagagccaagaagccatcggatgcatgcggttcatcctcccaagttttggtttcaaatgcggttcgcataagatctaaaccaggtgcaatgggtgatatcttgatctaacaaaattggcacaaagcaagattttgagttgtaatccatgtcccgtgaaattttctttttctcttctatgtagaaccagccgtacgaacaagcatagtaaccgtaggttgccaaggaaaagctctattttggtgaagtgaaaagaatgaaatacagttaaagctttcatttacattgtcggaaatacaggtcttggcggattaccgtagtagtattgtttctgtgccatgttattgaacacttagtcatattattacttgggcttggggctcggctaacgatctcccccaatctcagtcacagcagtgcgagattatagatacatgcgaatcgttattgggtgttttcttttgagaatgtcggtagtatggcggtgagtcacgtgatactaacaatcaaccactagtgtgaaaacaaaaaagaacaaggataaggcaaaaaggcaacaggcaaagacaaccttggctgcttcggccggaagttgagaatcaggtgtagtgtgtatatgtctagttcacggctgataaatacattttcgacaaattacaataataataataataataataaatacacggtttagcttacgtgataaattaaggcagcaacaacaatgagctcggaggaagagtatatattggtcactgagtgttaagaacttaaaaaaaaaaaaaggacagtgtttttcaccatacttgagcctcttcgaaatagtcaactctgtatttggaaacatctaagttgtttgccactgtatctctgatttgatcgttcattggtcctggaccgcaactcaaaattgctgtagaaccaatagcgttgtgaagatcttccacaattaaggattgtaagtctggtctaccgaataagaagtttattctggaaaattgcttgaaaaaattgatttcgcaatcttgagttgattctttgacgtcgagtttcttttcagagtctgtttcgccagcagatgacgcagaagaatctacgatttgctgtgtcggctgggtaatatagatgttgatctcacctagccggtcttggagtctcaatagctcttctctaaaccattccagtggcgaagtgtctctaatgatccagatccatttaacagtatcggtggaactttcagaaagtggtttcgttaaggcatcgtaattggagtatccagttggtacaccatttccaccagtgatgatgatagaattggaatagttcttcaatggggcttctagtccgtaagggccttcaactaaaacgttgatcgattggcttttattagatgtgttggctagactcttagctaaggatttggtgagaccttcctttaccttggcgtatatgtaaatgtgtttcccgtcactgtcgtcgtcatgagctaagatggtgaatggatgcgattgccaaaatccgtatggtctcatgaagtaaatgtagacaaaagcacctgggaacggtttccaagtctttggtctcggaactttgattttgattgtgttatcttcctcgaacaattcgcaatctgctttgctgaatactccaaaccatagtaaacggcagactctgaaaaaatggtctgcacaccaaacagcaatggaagcatacacgtattccatccattggccgctaaagattcttaagtgataccataacccggagatgtacaaagcagaaaataaaaagtgaatagtcttgaaggtttcataccatctgatacggaaatatgcagacgctaagaataacattaagccaccagtgattgttgcaattgcaccccaataccaatactgctcttcccagctcatagcaagatagtccatttcaaggtatgtccaacaagcagaatggattaatgcatgaacccacatccctcttgcaatccatttatgatacaccaagaaagtttcgtatggccacccagttaaatacaacaataggttatttctaccagatagtaggaacacagcaggtgtatggattgttgacatcacccctgttctatactgaaccaagctagatgtttgcatggctacctgatgtttactagtggtgtagaagttgtcagaaaagatatcgtaattgatacaacttagaatcacgttcaaagcaaaataaccgaacaaaatgtacgtctctgcccttgtaggaataatacctaagatcaactttttccatctaaggatttgcgtatgtttggtatttgccggtgggatggtgaacaaccttctgaacatgtttatcttgggtccaacgattttttcaacaagttttggacacaatattctagaccaagtaaccaatcctccaataaacatacatccagcaaaataaatgaatatggcaccaccataaagcctggtatgcttttgcgattgtgctctggtcacgtaggctctagtgtaacgcttcactttccttcttggcgcaatgatgggagaagtcagatttgtggatgcattgaatcctggcgtattatcgacgtcaatagcttctgatttaacttttgcatacagttcatgcaagctctcgacggtatggttgtatacaggcttactatactgacatctttttatcattttctccaacatactatctaaacgatcgggtttctggttatcaacgttgcaaataagccaggactggaatctgtttcttgtcggttgacaatttggtgcgtaaagggaaccaagatcgttgttgaaggtatatgcctgcaatgcgtctaagcatgcccagtacacactctcctccttggataggaaagtgtatttggctgcatgacaccaagatgataaaaatatgaagaacacaaccagggaatttcggcagcgaacttgcattttgtactcgactcgatttaactttcactggttatatatttcgccctctgaaatgaaaaggaacataacaaagctatacatatagatcaaatcttggaatattgataactggactgcaacagttgaaacaatgatggagtatttatacaattctatccatgcaactggcaaccgataaatagagcaaagaccatcgagcttctcgacctgggcggatcgctccgttaaaggccaagattcacatcattcggggtgttattcgtctatcggtgttgtctcggtttgattctctcgtaggctaaaatcagttagctgcactgaaagggcttgactctcgcaagtgtataaccgcaattggcaatcgagcatttaatgatcttaccaccgatccagtgaaatgcgcaaatgtaacaacagtgccaagcgttaccaacgaaatcatcgacttaagctttatgattcaacataatactactaaaatcttcaaattttgtggaaaaattcctccttcatccattgaaccttgaggctcatacatcatgatctgcatattgtttatagctagagcttgtttttagtaggaaaaaatgggataagggtcataaatgccaagaaaaaaagggtgccattttacattaagtatacctcgaaagtataaacaaatcaacaatttagactttcatcatcttgaatcaaagtatcgtatgcgacgttattactcgtagttgccgacgtagaacggaaaaaaatcatagcttcacaaaaaaaagtgaaacagaaaaattgggtgtcactaataacttacatgaaattgtcagggtatatcaaaatttctcctcttatgacttatggacgctcaaaatttccaccaattcttgtctttttctggctgtccaggagaatcttattgcggtatgcggttgttgatatgatcttagttcgatgtagggttcatagaatatcaccttgtggaatcttcaaaaagaaaaattccagagcccttaatcgccaaaaaagccaagcttaaaaataatatagagtttacggtttttaaaaaaatttccacattggcgctagaaaaaccaaaagaagttcgaactttaaaacgggcgatagacaggggattcgacagttttgatcttttttttaccttaggttatcaaataaaattattcaatgtacgttgcagcctcaccatcatcgatgcagcatgtattgtttaatgcttcaccagcagggtcgtaaaagcttgcccgttctcggaatggtttgtagataattttatgcagggcaacaaaaagaaaaaaaagatactttggagaggactaaaccaaatcgttacaattccacctaaaaactgacaatgctctccgaggtagaaattactcaagtggtttctttctttttcttactttccaattcactacagaaggtaagaatgtgaatcgttacaaaaatgcatattttcactcatagctattcgaaaatatttgatggaagtgcttcaaacgtaaattgtgctgtgttttaatgtgccaaatgatatacaccttttttgttagtttgtatttcatcaagtgaaaaatgcgattgaagatttgttggccgtctcgccagaaaaaagcatcttatttttttccaccatcaagggttcactcaactggaaagattgtgcttacccatcagaacattacttttaggtgttcacattaccacgagccacacaattgatgaatatctcaaggaactctttaatataaaacctcactccatttgatcggttgaattcgtttcccatattgacatgccgggctgtaaagccaagaaaaaaaaaacgggtctggaattttagacccttttttgactagcaaagcccgaagaaaatacaaattagaaaaaaagcttcaaacggttaagtataccaatatatctgagataatatgctgagatttctttagaaatttacgttgattcatggctgggtgtatttttcaaacagaacgggaaagggattaaacaggtcacgtggacactaggacatcatgcaagacatttctatattgagtactctcttaaatttttcaacacctcgacagttaaaatgcaggagcagaatgtgcattatattcgcctacgagaaaactacatagctccaggcaaagaaaaaaagagtgcgaaaaccgttaaccatgtcctggacactaataaaaaccgtagtatatgaaaacatcacctgataatgcggttcaacaaggaatggtgaaacctcgcattacctgggtaactcaaatgaccgcagttcccgtcagaaagaacttcagaaagaacttcagaaagaacttcagacaatgcagcttattttcgttgccatgcctacaggaatataaggtatagtggaagcaaatactgaacacttgagcacttttccgaccgaaaagggtccattttttcgtttatagaactgcgctttagggaaaaagcaatgcactgcgctaactcttcacttacagtattttcggtgttcatgatgccactttctaagatagcgtctgttggtgttcttcgtttaacgcattgaaaaatctttccatagcgattttcgttaccttcattgcaagaataattacagcatggcgagcgttacttgggtggccatttattctttgcagaaatttagtgagttgaatttaagatgcaccggagttatttgctctgttcaggcaactaatgaccattagtgcagtgaagggtcaatcacttgtttttggtcgtgtatttaagggtaaaaccttttggcatttgtcattgtctgtcttaagagaatctagtattcacatgtactcttatcctctaatattggactaatgattttttgtttcgactggttgactttatcatttggttggccgtgtgctcacaggttgaaagattgggagatacacagagaacatattcccattaagccgtaattgagagaaagaatgggtaaaatatctgaatttttcgggaaccctgggtatcgcacggatgttcatcaaaaagtgccaatttcttctacgcggaccgttgacggcctccagaagatttctgataatgaccctggccatttggtagaagtagagacttcttattcatcatcatctgtcgtagtgggagagcttgaagttgaagaaaatggtgatatttccacgtcaatcggtttcactggtttggaaaaaaacagaactgatataatattggattggttggtggaacttgccggttcgcaaataatgtttgttattatgatggccattcttgttggttggataattgccggtatcattacgtctggttcctatgattggcaggttgtcatggatgacggacagtcgatccaaagttatgtatgggacactttattgatgagacaacaattaatgtccgcacatgagcatatgtgtatttgtgctgagttaggttctagagtcaccgtgttcaaaaaattgctcacgcggatcattgatcagtcggaagagaaaaacactaaggctgtggatcacatgccagagatctatgaagttaccgcggatttggaagatagttcgtggtacgacaagttggcatctactgtcagtagagttcttggttcgtggtattccatcgttatatactggtgtggtatcattgcttgggtcggctgcggtgctttgaccatagacgctggaaatacccctccatacactggcagaactagcggcagtaacccagaaatggcaaaattcggcaacttgtggcaaatgtatatcaatactgcaacagcggttattttatatttgaccactgttttcttacagaacatcagagcgaggcatgatattttcgttgcgaaatacattagggagatcttcgctatggatcttaaaattgattcactcttgagaaaacactctaatgattacactaccgaagctgatgttgtgactgtcgaagctcaaaagagaagtaggggcgagatttggattgactggtacggtgacattatcggtactggtgtcggtgtcctcatcggtattcttgtcttcactgcatggattgtagtcggtcatccgatggggtggagtgataattggtggttaattatcggtacatatacaggtttggttggattttttgatggttttgtcatcagacaaaactatttccgaatcgtgaagagtgaaaaggaaaactatgaaaatgtgatagctgatgatttcgaattgttctccatcttggggattccatgtcccgaacatctagcagaagtaccacttgatgaaaacagatcagtcacctacagagtgtctgtgtacatcaacagaatttgttcgagccaactcagtgtcttggcatctatcatcttcattatcgccctaatatgtattgcatccgcattaaaatggaacgaaacgggccaattgctcgcaaatacacctaccatgataatcgagggcttcttcttgttgatcttattacaagcgcataattgggcagatactacacgaaggggcgagatatcgttgttgtacaacagaaggaatttcttattcgcatatttgcagaataggtttggcgaaaagtctcaagaagtcaagacataaagcaatcagttcagtagcatatgctcacaagagttatacctcaaccatatcttttatagttttttccaaattagttctgattttctttgtccgttgtagttgtagccaacgataatgtacattctttcttaatgcaaactgggcatcttgcgatgaaaaaagacgtcagtttattttcatgtgccaggatttcctctaagataaccgttccctcaactacatgattatccttttccgagaagttatttcacagttgtatgttgtactattcttatgtctacttattgccagttaacgattgagacggctgttctctattttgccataatgacgcgcaccacatcgaaggaagttactagttgttggcagcgatgatcataatgttatcaaattcatcctcaaacttgtcaacagatagacatcaaaggtagtaaaccacatcacgcacagagaggagggtgatgtcgattaatctcatattctcaaggtagaattgggatacaagaagggagagtatatgaaaaatctggaatgcagacatcactataaggaaaagccctcaattatggatgctcaggtagctatatctcccctggaatataaagatgaatcaaagcaaaacgttggtagagagtcgcagtactaaaaagtctatgttgaacacaaacacagattctgaaatactgtatcaggtaaacgttttagtatcatactaataaaatttcaacaccaaagtatcggaacggattgcacagttgcgccagtatccatgagatgccaggaataaaaattgacatggagttcttccaggcgaaagcccaataaaatcatctcaatctcaaatacagtatataatggttggttgatgaatttttagtagtgtcagatgtttataggagccgttctaatttgcagaattgctcagtactcttagaaagacctgcgaagtattttgaatcacgtgattatttcaaagtaagaggagtagtaggagttatatcaatagatgccattgcgacttcgtgttcagtggtgtaatggtcggatgttatatttgattattaggaaataaaaattcgattatttaagtatattatttactatgtttgccatggtttcttccgtatgatataacaatatatgtggcataatagagcaaaatatcaacgatatcaaacgagccaattggatgaagattctacttacgtagattttgaactggttcgtcagtcagcagacgtatagtcttgatcctagttcactgtcgctttcagctaaatgttaagaaatgattcaataaatggcgccttagaaatgtcactacaacgacctggtggtagtattcctgttgtaaatattatgcagtacgttcagatgctaatgattatgttaatgcgagaaccatcttgaccactggatatacagtgtggaaaagtacttattgcaaccatttattctactgattatgatggcaaaataccatcaaaccaccaactatataccgacagtggcaggggtaacggaagagagacttctactccgtcagattcaccgaaggtgttgttacaagaccgccagcaacatcttttttcgttatattttcagttattatattatgtagtgtcggtttttgaaggagcatcttctattcgatgttgattccgctttttccctaattttaaagtgacattacaaaccgtcttgtctatctccattccccccgactagctattttcattgctgtgctgcttcctttttttcatatttgtgaagaaagtcacgatttgagatgcaaatatgaaaatgatgcaagttaacggcagtgctaaaatgaaaacaccagactgacaggttggataaagatatcggtgatgtttttcatggcttaacgctcatcaaacttcccaaactgtacagtcttgaagtttctccagcttcaacagcttctttagatattaaaatgttttcaatagaaaatatacaagttatagaataaaaactgatgaagctaataaaaatgaaagaacttaaatgtaaggctctctctcttgaaaagccgatccacctttgatggcaagcatttcaattgagagcagaaacggtgaatttaggaaatagtttggttacaataccaaatatggtaagaacaataaaagggggcaccttatactttttaaaagcttaagctatcgagtttcgataagtagtggtgaataagaatgaagacgaacggaatgataaataattcggtaccctcttgaaaaaatagagaagaaagaaagctttataataatgtaaaatagtaagaatctttccgttgagaaaactaacggttctgtccacttgagaagaattataataatgctaaaattgctgctatgaaaggtgttccaagcagtttgacagcattatcctcatataatgacaccacctcagatatagatgatgatgatgctgatgatgatgatgatgatgaagaaaaatttactgtttgtttttctgtgcttgagccattttgtttatgggcggttccagtctcattcgacacatcagacgtggtagtgatatcaactgaatgacctgaattattattagttgcagttgttgcagtggttgagtttgtactagaagcctcgtcattgtttatccctgtattagggaatttttcagtactagacattccatcctttgttgattctataggaatggagaggtctatagtagaactttcatctaccaactttgaggattgagattctagagatgttttctcagtaacagtggtatcaataggacaagtggtcctgtaaacagtagtgacgccatttcttgtagtggtgataatacatagggaagatgttggctctatttgagaaatatcagacccatcggggctggaaacattgtcagtacccgtggcggaagcagaaccagattcattaccggtacctgtcgcagaacctgaaccagattcattaccagaacctgtggtggtagctgagcctgaaccagacccagtaccattgtcagtacctgttgcagaacctgaaccagattcatcaccagaacctgtggaggtagctgagcctgaaccagacccagtaccagattcattaccggtaccattgtcagtacccgtgaccgaagcagaaccagattcattaccggtacccgttgcagaacctgaaccagattcattaccagagcctgtggaggtagctgagcctgaaccagacccagtactagattcattaccagaacctgtggaggtagctgagcctgaaccagacccagtaccattgtcagtacccgtgaccgaagcagaattagattcattaccggtacccgttgcagaacctgaaccagattcattaccagaacctgtggaggtaactgagcctgaaccagacccagtaccagattcattaccggtaccattgtcagtacccgttgcagaacctgaaccagattcattaccggtacccgttgcagaacctgaaccagattcattaccagagcctgtggtggtaactgtgcctgaaccagacccagtaccattgtcagtacccgttgcagaacctgaaccagattcattaccagaacctgtggaggtagctgagcctgaaccagacccagtaccattgtcagtacccgttgcagaacctgaaccagattcattaccagagcctgtggtggtagctgagcctgaaccagacccagtaccagattcattaccagaacctgtggaggtagctgagcctgaaccagacccagtaccattgtcagtacccgtggcggaagcagaattagattcattaccggtacccgttgcagaacctgaaccagattcattaccagaacctgtggaggtagctgagcctgaaccagacccagtaccattgtcagtacccgttgcagaacctgaaccagattcattaccagagcctgtggtggtagctgagcctgaaccagacccagtaccagattcattaccggtaccattgtcagtacccgtgaccgaagcagaaccagattcattaccggtaccattgtcagtacccgtgaccgaagcagaaccagattcattaccggtacccgttgcagaacctgaaccagattcattaccagaacctgtggaggtagctgagcctgaaccagacccagtaccagattcattaccggtaccattgtcagtacccgtgaccgaagcagaaccagattcattaccggtaccattgtcagtacccgtgaccgaagcagaaccagattcattaccggtacccgttgcagaacctgaaccagattcattaccagaacctgtggaggtagctgagcctgaaccagacccagtaccagattcattaccggtaccattgtcagtacccgtgaccgaagcagaaccagattcattaccggtaccattgtcagtacccgtggcggaagcagaattagattcattaccggtacccgttgcagaacctgaaccagattcattaccagaacctgtggtggtagctgagcctgaaccagacccagtactagattcattaccagtaccattgtcagtacccgttgcagaacctgaaccagattcattaccagagcctgtggtggtagctgagcctgaaccagacccagtaccagattcattaccggtaccattgtcagtacccgtgaccgaagcagacccagtaccagattcattaccattgtcagttcctgttgcggtagctgagccagattcactatcatcggtagttactgtgactgattgggattgactgtcattgtgagaagtactgacagtacttaaagaatatgttggttctattgaagtgttgtcagaaatggttactttcgatgtagtagagctatcgaatccactactgtaggtcgattcaggttctgctgttgttttaaccgagtaaatggttgttattgtcggaataccatctgaaccagtgactgtcgtaagatcagttgcaaaagtgctggtatattcgccagtccagccagtatatacggtggtagcagtttgaacctctggggtctcaacagtgtagattgtcttcacggttgggataccatctgacccggtctctgtgacagttccagtaccaatactgttggtagtagcaccggtccatggggtgtaggtggttgtggcagtttggactactggagttttaacaacaaccaatacttcagtagtgcttgacccatcagcaacttcgcatgccgtttctgtcgtgtatgtcgaagtgaatgtttgcgtccatggctcggtagtggtagcgtcaataattggacaaccatttccagatgagtcgtccggaaagttgaagatgtaaccgttgaatgtcggatgctggagaccatttgggtccacaaattggaactgcatagcaagattgcctcgtgcgttgagatataacacccttaatggatagaaaaccccagcttgcatgctaacagtaacactagagcttgtaacaccgaaatcgaatgttgttgggttcgaaatagtgtcagatttttgacaacaatcgaaggcattgccagctccaatactaccataggcagcttcatcaacgttattgagcaggaactggtaatcaccggtcatacgagcataaaagtatcctgataaaaccatggtgaaattagacagcgcgattgtctcaggatagttgaacgcagcgggcaagttaccgttgatgatactgtagcagcgagcggtctgaattgtcataccgaaagtcacattcgttaccccatcacttgagccgatgtacccaccgccatatgttttgtaaccgccttgttggtaatcggttgatccgtaagtgggatcgacgtcgtaacagtcagtacccccaacatacttcattggatagtggtaatagtcaacatggaaacctgcagaactgactctaccggcaccattacaaccacgaatggcatctgctttctgatacaaacaggaggaaaggatgagccaacatgtgaataaagctaaatttggcatctttctagcaaagaagacagagtgcagagaagaattgcaaaaactctcttatttgctctctttccaaatgtattccttattccttgataccttttcttactttatgttttttcaaggaagctattggatgtcgagtgctgaagattatgctggatgttgttattatttcaaagaaatactttattaatgaaaatatctaacagaagaaaggaagaaaaaggttgttgaacaaagaatctgcttaggttcgctggtatttatctgatcaatagcctaaatttccaaggtcaaagtacactataagacagtaaggccaaactattataccgcggttattctattattgtcacattgggctatgcaaccgttccgtttttattttgtttcaacccattgtcctgtgatttctatgcatgcagcgcacattgtggggaatgtggggaacgggtattctacgcattcgcttgggatctctctaaattctagaatttcggaattttaggaattttcggaattttgcgaatgttcgagccttacaggcaaaaaaacaaaataaaaaaggccactgacatttttttatctggggtgcctgccagtacaagaataggcatgacaaacaagatggttgagctctactagtaattcaccggacgaataaaagaggtagtgacaaacgggtgaatcaatggaaaataagaacaatttattcagactggtactgacgaaaactttctctttggaagaactacaataattgctcaccttaattatcggagattttcccaaagtaagtttttccttttgataaacctcgacataaagagtctttctgaatccagatgacctgataactcgttactagggctactatctttgtttggcattttgaaatctgcatcacgctcggtcattaccctttgaatgattagcttctgggtgattcgatgccaacagtgcttctagaacctttcagggactttggtgttctttaactctgtctgtttcctgggctaaaagtacgaagagtaacaaagagctgttttgcgagaataataacgatatgtggcccattgttttcattcgtgaaccaggcaattgtatgaaaatcccttttgaatttccacgcatgcggagtgagaacaaacgtggagaaccttgttgggctattattggattgcaggaaaatattaaatggcattctgcgaaattcatataggagatgcaaatcctgtttttgcaacatcctgttcattatcagcattatacggccggcacgcacttaaagaaaaaattcatgaagaaaacgaaaagaggaagctaaactgaagtcatatcctgaatagttgattcttaaatgatcaactcactatggcaacaattgatgtggcctctaataacacctacgtcaaagtctaccaccaattccaaacgatatccagttctgctgttatagaggtttatttactttaacttgtttaccggatgctgtaaaaaaagaggaatataaacgactgaattatgaggacggtagaacccttcaagaccgaaacatggttcatattgtaaggtgtgactggtttcacatacggaaaatatgagccatgtttactagaagaaacattacatatactactgtgagtatataggcgatcaaatctcatcgtttaaaccacagtgtatatatatatttggtacaatatccactcgtttccagcttatctttacacattgatgaaatttttgaacctctcatcagtaaaattaaactggaaataacatacgacacagttaaaggcgacagtgtagcaatcacgatggcgttcacagccttagttttaccaacataagtcgtttaaccaccacgacgtgtgtctgtgagaggaaatgtaaatatgacggaccttggttactcgaatgaatactcgcatgctttactattatgagtcgtagtaagcttccttctgacttcatcatttccgtgactcaccggacaactcattcatgatcaaacaggcttttataaatattgccaaatttctattacttgtggtctgacaacaaattgttattcttggagcgcttgaccctaacagtgtgactgtacctaagaagtatgtcaatgccatttacatgaagagtaatcaggatattaacaagacaacaaatgtgcagggcttttaggttcaaggagtttcttggcattgaaagtccctgttggattttatcccaccttatgtacgattttaacctttgacacatattaaatcgcgtgccgtatcggttatgagttgatgtctccaagaagcacacattcatggtatggatgcccggttggaattagcaaacttgatctatattttgtcatgtttaactgaatattcatcatgtttggtagtaggggtttggcccagagggttagtggtattcatgtgaatggataccatttgacttgaagtttatgatgaattaatggataattaaattggtgatgggtatactaacttcgattgattaagtaaattacttacggtgttctccttagtttcttctatctgacataagttaatgtagaacaataattaatgtgtaaccgaatccagatgggaaaattggatgaagaaaccttctacttatatactttttagattggttttccaagcaccaaactctgtagccttgatcctagttcctctcagcttcggcttcttatttagcattggttcgataactggcgccttagaaaagcacctacaataccaggagtaccatgtccgtatatctttaatttcatttcgcaggaccatatatatcttgtcttacttttatatttgcatcttaaatcttaggtggcatccagttatccaagtccttactaccaactctggatattatccaatccaacaaattttattatacaatagtaaaaaggtaaagtactgttacatataatttaaagaatattagtatatatttttgttaatataacggtttgagaaaaggtgcagattgaaatcggtaaaacagcaccacttattttctttgactcaaatagttttctcgtcgttgtgaaaagtatttatcctagtgaaagaagtagtatattgttcgaatggatcttgtacagatctcttttctaaatcactttctggattttcgactctgtctttgcttccgaaataacgtctcttgccgtacttgtacaattcagcacctgcccagaatgccaaactgaagccaagagagaatccccattcataagtgatatcgtaatgtaagaatactttgtcgttaatcactgggatgtaaaccaccgggaacacagaacaaaagccaccaacaattgaccagaataaaaattgattgctccagacatctttgaacacttgcgtatatggtgtctcagtttcaggattcatcatgaagaatgatcttctcatgtcaacaacctcccaagctaaaattaatgcacaccacgtcatagttgcgaatgctgcagcacggcccttgaagaccaagcgacacgaatcatcaaagccattgttacacccgcggcccaaattaccatcaccagtaccatagattaccgtgacaaaacatgccatgcaacatgctgcaataattacaccatagacaagcatatcgacgatgacttcccacgtgaatataacagctttggcatcctttggtggcttctccatcacgtcaacattagccttctccaaaccgagacccattgctggaaaacatgaggtaacaacaataacccacaaaacctcgacaggagataatgggaatactgagaacccttcctcatcaagaaaacataaaccaaccatcaagtacaaagcttgtgccacattttctgctaaaagttgtaggacgaatttctggatgttatcgctcattcttctaccttcttctacagcatttaaaatagaagcaaagttatcatcgctcaacacaatgtcagacgcatccttcgcaacgtcagaaccattgattcccatggcaataccaacattggcaatcttcaacgatggtgaatcgttcacaccatctcctgtcatggcacagaacctgtttcgacgatgcaaggcttcgatcatgcgtaccttagtttgtggtgcacaacgggcaataaccaagggcaaaactggtagctcatcgatttccttatcactcaaagcgtcgaaatcagttgctgtcataaccataaaattaacgacttcttttggataatgatataaattgtgaggtaagatgccaacttcttgagctatagacttggcagtaccagggaagtcacctgtcaacatatggacgttgataccagctaggtgacattttttaacagcagcaagcgattcgcgccttggtggatcgtatataccgactaatcccaaaaatgttagattattttcgacaaagtcacgttccttcaatagtttgtccttgttgatagtaaattgtgattcgttaaaggttttcttggcaaaagctaacactcttagcccctcacttgataaggtatcaacattcttttgaacagtttccagatcttcttcggtcaagggttgtggactgccatcaggagtggtataccaggagttgcaacattgtagcactctctcaaaggcccccttggtgaacacttcgtaaattggagcttttggctcttccacattcttatatatagcggacattctcttcacgctagaatcgaagggatattcggccacatgctcgaaagtgatatcattgtgaatgttcttttcatcatcgttgtcttcaccagttagtacgcgcctaggtagatccattctagtcgcgaacacttgaatagcgatttctgttgggtcaccatgagctttccaatcttgagtttcgggatcccggaacacagtagcgatattagccaatgtagcggtgtataaccattgagtgaataatgaaacatttagcggacccaattcatcagcataatacttggatttgaaatccgttatcataccgacatcttcctcgtcatcatgtttgtattgatatggagaaaatttgggaattaactgaatttcacctatggtaggattgaaaggttcattggaattctggacattgatagttccaaattgcggaatccagacttgtttggcaatcattttaccttgcgttaaagtacctgtcttgtcagaacaaatgtcgttaacggcacctaatgcctccaaagaatctaatttacgaatgataacatgtctagttgccatcactttagcgcctgcagacatggtgattgttagaacaacgaccaatgacgatgggatcattgaaagtgcgacacaaatggcatagatggcaacttgtttgttcaccttaaacttttgagtacccataacgacaatagcgaaaatgactgcaaccacgaataatagaatagccaattgagacaacttacggtgcaagggggtaccgacgctggttcccaggaacgtgccgatagattctctcaatgtaatccataagtttcgtccaaatgacttggacttatctcttgaaattagcgaagcctctgactttagcgacttcgctatcttaccaatttcagtgttcaaagctgtctttataacaataccagtcgctctgcccttcgtaactgtagatgctgcgaaggcaaggtttaaacgatcaccaacaggcgtatcttgttcgtaaacttctccgtgagacttagcaactggaagggattcaccagtcaatagcgcctcatctgtttccaaatttattgcttcgaatagcctcaaatcggccggtactgtatcgccaaccctaataatacagatatcaccaggcaccaattcttttgactcgattgtaagatcattaccagccctgataacatgggccgacggagtggatagtgatttcaatgagttcattgtcttcgaggcgttatattcttgatatgcacctataacaacgttgatgaaaacaacaaatgcaatcacaccaccagaaatccagtctttgatggcgaacgagatgaccattgaaattatcaacaccataatcatggcattacatatttgactaatgaaaatgcccttaatattaatttttgaatcatccccaagagtattttcacctattagacccaatctttccgcgatttgtgtagtgttcaatccctggttaatatgtgtggataacagcgtttccactcgggacacacttaaagaatggaaatcatcccttgcataaggagaatcaggtggaatctccttagacttggtgcccattgagtcttactgtatgttaaaaatttcggtgaaataatcactttgaaaagtactatagtttgttgaatcggcaatgtatcagaactgtcttcaaaactaatctgaatatagtatgattaatgtccggcgagaaccactatatgaattttgacgctttggtaaccccctaccactagggtcttcatatttctcttttatgcatgctttgcaaaatttgtagcattttgtattgttaagaccagaatagatataagaagacgtgaaaaaaagaaatgcgtaatgacaactaggtcagaagtaagaagctgtgcttttatatttcagaaaagcacagggctaatgtttcttacgaattcgatttgttagttttatctagcataacggttgtccatgtcttcttaaaaaataattcgtcttcaacttcttatgagtctttttcagccattgttcagccacttactgtatggcaagggaagaagctgatgcatgtactgtcaaagacctttgacgaatcaaatttcttgtttaaagaatactttactaccaaaatgtttcgagaatttttattttgagtctcatttgacattccctcatgcctcatgcttgcttgaatcctagttcatcatctagtagtgaagtaaaaagaaatcgtcatttcacacccaactattttgctttttttctagtagttcaaaccctttgaggaagactctattatgattagctagggtcgactgaaaggttagatcttaatgcaagtagtatctgtagggtgaattatgtgatcaataaaaaaagcaagttcgaaagggcctttcgtgattgcctttcttacagttgagctaccgtttgttaatggggaaaaagttcctattgaaggaagattggaaaaaaaaaatgacacccaagaaatatttggttactattaagtttaaagtgccaagtcttgatctgccaagtttttatccgttgtcatatgctaagatcttgtggtaaacatctgatgttatgtaacaaaccccgcaatggtattaaacggattcatatggagacttacaatgcatatagtaagatgatcatcaattaatgtataaatatcgacagaaaccaggcaagctgacattttaaggaaaggcaccttgtatattttaaggtcctatcaaaatccacgatctagaacattaatcaatggatcagtctgatatgaaggttaatatggacagaaagatccaatcgagatcttcgtcatttgacaataatgaggattctttccccaatgcgaacaaggaaaacttaacatttgctgaagaaaaccataagcaagagttgctagatgaatatggtgtaccagataagttgagagcgaatagatcgctggtaatcagaaagatggaaattatgaggaaacaatatacctctgttttcgctatttgtgtgtttttgttcacagctttcttagccggtgttggtactgatttgaattcacaattacgtaataactatacgacgtatgcaaccaactcttaccgttcacactctttattatcaactattggggttgttagttctatcatcagtgcaggtgcgttgactgtatatgcgagattgtcggatgtgtttggcagaatcagattgtacttgagtgccatgttgttcttcgttgtaggtaccatcattcagtcgcaggcaaataatgttcaaaaatacgccgctggtactgtattttacagtcttggaacagctggtatccaggtgatgatgttcatcataatgtcagatttctcgtcgttgaaatggaggttgtttttcacgttcgctccaacttggccaaatcttttcataccttggatcacgggatcaattgttgatcgtttagatccagttgaaagatggtcgtggggtattggtatgtgggctttcatttacccgctgtcctctgtgccatttgtagcttacttacttctcgttagatataaggcaagtaagactgaggaatggaaaatgttgtcctcggagaaaacatactacgaaactcatggaatcattcaaacgttagtgcagctcttttggaaggttgatgttgtcgggttgttgctgtttgtggcgttccttggttgtattttggttccattaactttggccggaggagtgtcttcacaatggagtaacggtaagattcttggacctttcattttaggcttctgtttggttccagcgttcatcctttgggaaaccaaatatgcaaggttacctatcgctccgttcaaaatgttaaaagatcgtggtatctggtccgccttaattatttcaatgttggccaagacggtgtattatttggctgctgggtacttattgaccattttgatggtggcagtaaatcaatcaagagggatggcggcagttatcatgaacgtgtggtcagttgttggttgtgggttttctccatttttctcatatttcgttgttagggttcgtaggctcaaaccattcattatcattggttgtggtatttggatggtctctatgggtctgttatactactacagaagtggagagcactctaagggcggtatcattggagccatggttttatggggtctaggttccacaatgatcacgagaactactgtgattagtagtcaatctatcacagcacatgaaaatatggcaacaattactgcgatcatgttggcaatttcgagaattggtggaggtattggttctgcagtttcgggtgcgatttggacgcaaactttatatgccaaacttgttgagacaattggagacccagaaattgctaagaaggtttaccaatcacctctttccgcgattagagtttatgcttggggcacacctacacgtgatgccattgttgaggcttacagacatgttcaaagattcgaggttctggttgcaatgattctggtaattcctttgtttattgcttccttgtgccttcgtgatcctgaattgaccgatgaagttgctcatactgatatcaaagatggtgaattcattgcagttgacggtaatgatgctattgctaactggttcagcaataaatgggaaaatattaaacttagacgtagatctcattccgatgagtagagttttctgaacattttgcacaattgcttggaacctgattctggaagaaaccatttgacgtactttacgtattacatttattattttatgccatgtaggctaaaaactgcgcggcgtttgcaattttattacttgcagcatgtggtcagtatgacatcgtcagatgcggtaggcaggcatatctgccacgtaattgacaaaaggaagaaatttatccttcagtaagttttcttgcagcatatcgtcaatttgattcattgcatatattatcacgatctttgtgcagactgcaagcgccagtatcatagccaatgctgactgacacatctggcaaatcgaaaacaatgtccaatcgcgtgtctcacaatccacgagtctgatgcctagagaagatgttgcatagactgatatatacagcaactctaaatattgattctactccatgacatcgtgaggttgcttcaatttcacattgactttatataatatcggtattttggtctatgacactaccaacgtatgtatggcaggggagagataactaagtaagtacattgtaaatattatagccaatcgtccaagtttttatcgcgatcagaactaaaagaggaagttattctatttctttactaaaaatcataagacataaaagacatctagttacattataaatgtggacagtgaaacatgtttgtaattaaccgtattgctcaactacaaacctgaccagtaagaggttttctccacgtcgaaagattcactcaggacaatgtcatcggaagaagtacctaccaagactttgtactgaccagcttctgaacaccacttaccgacttcttcatcgaagaaggagacagagtccttcaagactaaatcaatctttgctgtttcggtttgcccgggttgaagtaaaactttcttgaatcccttcaactccttcactgccctagaaacagatgattcagtagcagcaatataaacttgtacgacttcagatcccgcatatttctcacctgtgttcttaacatcaacagaaacagagataacttcgtcatttatttgaacttgcagattagataaggcaaattcggtataagataacccgtaaccgaaggggaatgcaactcttttttgcagcttttcatagaatctgtatccaatgaaaatatcctcaccgtagacaactctgccaaattcagtcttgaagttcaaataagctggattgtcttcaagctttaatggccatgagagagataatttcccatttggaacaacatcaccatacaagacgtcagcaatagcattacccagctcattgcctccgtaccaagcttgaaccagagcattagctttttgtaaccatgggaactcgacaggagtaccagactggttgacaattacagtgttagggttagcctccaatacagcacgaactagatcgtttgttcttgctggcaacgtcatatcttccctatcatggccctcagattcccattcagcattcaaaccgatgcataaaatggctttatcatgagcggctgcaagctttgctgctttcttgatttcctcatctgcatcaatagctttggtgacaccaacctgaagagcaccagatccgaattcactcaccaactcgcttgttggaccagaaccatattcgattctgactttatacgctttacccttttgtaaagtaacagtcttggtcttttcaatggtaccggcaccgaaacagaaatcaccactgacttggcccttcctctgatcaatcaataattcgtcgtctaagtacaaaacaccggtaccgaaaacctgcaaaccaaatatgtagtcggcatcttcttcaggagtgaagtaaccttctaatgtgatgtaaaatattgggttagtggtgtcaattttttcatgcttgaaatcgaaaagcaagttgaaagagtgtttaaaggtagcaacatggaatggagattcatcctttgctctcttttcaacgggctcactgtagaaggaaccggtagcacctgcattgtctccctctgctggttttgagggatcgactaccagttgctcaattaaattagataaagtcttatgagactctgccccaattgtgtatggtacttctttgcccactttcttaacaatcccttcgtaaggcgaaataacatagtaagaattcacggaggcagaaccacctccagaagatgcctttgctttggcatttggaccaataacgacgattgattcttcttttttcaaaggtagaatagaattctcgttcttcaacagaacaatagaatcggcagctatctttctaagcaattcagaggtttctttagtgttgttagatgtagtttctggaccattttgaacaatccccgtcttttcctggttgtcaacaacaaacttaatcattttcaaaacctgtctaacacggtcgtcaacgtcataaatagaaatttgttctttggaatttagagagtgtgatacaagttcattagttctccatctcgttggacctgggaactcaatatctaaaccattcttgatagaagcagcagtggtgtaagtaccataccaatcagacatgatcataccgtcccaattccattcttttctaagaatgtccaacaacagttttttgttttgagaacaatgttcgccgttcaccttattgtaagcggtcattaaacaaacgggatcggcattcttgattgccaatctgaaaggttctaagtaaatttctcttaaggctctttcagacaggatagaattggaagcaaaacgttgatcctctaaatcattacaaacaaagtgcttaaccgtagcagcaataccctcggattgcataccttgcacaacagaactagtagcaacaccagccaaatatggatcttcagagaatgattcgaaaccacggccacccaaaggaccacgctgcatgttagttgtaggccccaaaatcacagcagcattcttggcaacggcttccttagccatcaatttacccgcctctttcaataattcatcatcgaatgtagaagctagaccagttccgttagggaaacagcctgaaggaactgagtcaaaaaacctagttcctctgataccattgggaccatcagaaactctcactgatggaattccgagacgttcaatctcctttgtgtgccaaaagtcaacagctgatagtaaagagattttttcatctctggttagttcgcttagcgtttgttcaatatcaaaattagacatgattcaagaaattaaatacaagtctgccagtttaagtgcttatgattattgtattgttcacatgaacaacaagacagtaatcaataatgataatacaaaactagactgggtcaattgaaaccgtaaaattgaaaaaaaggttctcttaaatacttttcatgccaagtatcattaatccaccatcgtctcttgtagtcttcaataaagccgcccgccggctatgtacaaaacaaacaggtgttttaccgttcctccaggaaacgttcgagcacacttgaaaataaggaaaagctactacctggtataattttatccggtagtttgacagtttaaagacaaatttttagtcattgcaacgaaaagcaaaacccatataacaacaggtagacaggttgtatgactaaaagtatgtcattattttcatcgtcatataagttcaatccgcggctctatgtttagtgtaccaatctcaagttccggtagcccagatagagacaactgactagtagagtcatcttttgaataccatcaaacacaaacatgttcctcctaacatatacgtagtggaaaacgtctatcacatagttgcaaaagagctgtgtatctatccccgcaaaatatattatccgacttcacctatggggaaactttaaaataaattcgaggaaatatttccgaattcaaccagtatatccgttctccgctataatcctgctttattccaggtgtttctgttcagttcaatgtttttctagtatgacttgaagaacagggacaacgccaactcgttagtccattgtgttgaacattcttgcgtgttttcgctcggttgtttccgtagccacggaatatatctgcatatttaactgattctcctttctttattatgtttaaattttctggggtaatcacccgtttctcacccactgcatcctcttctgtgctgatgcggcggaagcggaaaaaacaatggctgccgaaaataaagttaacgtgaaaaaggaaaaacaagccgttcgtacctctttcgtgttaccccgcaaaaattaacagtggaatattgaaaatactaaccgttttgcagagctttttgcttaatagtacactgtattctgtggaagtaattcctaagagatatttcgaactatcttcgagaggtgactccaacttgggtagctattaatggtactctggggtggcttcagccactccagtgtctctggaaaaattagataaggattcaatagtaagcaatatttccgttaccagtcaaagcgcgctttgacaccccactaaaagaacgtataccgtgtctgagatcgggtggaaataagcaacgattctttcgaaatttcgctgcatgtttttctttatggagcaatatattttagtaagtaatgaataatgaagagaggaggacaatagatctggagaaaaggaatatatttcgcatttacaactgcgatcagtgattaatgatacggaggaatttcattgttgggcaaatgttctcatgatgctcagcagtagtttcgaaggcaagccgatccagggtcagagtcatgagaatagtcttgatcacaatcttgatcattagcgccagcctttcatcgaatgaaaaaagcaaatgaaattccagattgggttctcattgttgtttcaacaaatattgacacttccagtgcaataaaaatttagctctgacgccaacatcccccagttttgcatttttctttggtgtgttacgttgatatttccgaaaagtttaatataaaagggtccaagtgagagcatgtacttccttatttgccgaatgattttagttgtagttttcatacattctttaattaatagggttcattttcaataccaataaaaaccattgagaacggtattagaattattacaatagtgtcgtgtacctgataacaattttttttgaaacatgtcgagtgattcagtttctgacacagtaaaatatgagatcgctgactcttcttcagcggataaagtcaatgtagaggatagacagcacatggtgatgtctgacgtcttgcctgacttgggtaagccgttctacaaggtgccttatctaagaacattgtcatagttcatttttggtttatcgctatcctctacgaaccttggttatgatggttctctcttgaacgggttgtatgctatgccagactatctaaacgcgatgggtaatcctaacggtgcagagttgggtgttatctccaacggtatgatgtttggtatgcttttgtgcttccaatttgcaccatatgtcattgacaagtatggccgtaaggtcgggatgtacgtgggtaatgtcttgatttgcattggtgtcctcatccaagcagtatctggtgcatggatcaatggtttaccagaggattatgacaagaaggacgtgttcggtatgtttgttgcttcacgtatcgtgttgggtaccggagttttgttgatcagtatttcgactccagctttgatctcagaaatatcataccctcctcacagagagctttgtacctccatatataatacatgttggtaccttggtgctgttgtctcagcttgggtcacttacggctgcagaaacctagctcatcattggaactggagaattccatctatcattcaagcttttttccctatcgttcaactcattgtgctatacaactgcccagaatctccaagatatcttgttttccataacagagattccgaagcaagggccattttgaacaaataccatgcaggtgataatgaggaatacgcgggcttgatcgattttgaattggcagaaattaaactggctattgaacaagaaaaagcttctcaagctaccaacttctctgatttctttaaaacctccggtaatcgccatagattgtggattttgatctggactgcaattttcacacaactttccggaaatggattggtgtcttactatctatccaaagtcttcaattcgattggtattacagatcctgatgagcaattagagtggaatggttggttaatgctttacaactggttatgttcattaattttgatgagttacatcgccccattcttcaaaagaaggcaattatttttgatatccttgacttcaatggcctgttgctacattgtctggacagctttatctgctgaaaaccaaaaacgtaatttcgaggataaatctctagcaaatggtgtcttggcaatgatcttcttatattatctttcttacaactttggattcaacggttacccattcctctacacaactgaaattttaccttacactttgagaggtaaagggcttacaattttccagttggccattagtcttgcagttattttcaacgggtttgttaactcaattgcaatggatgctattgaatggaaatactacatcttttattgttgtttcttagccgttgagattgttgtctgttatttcactttcgttgaaacttctggaagatctttggaagaagttgacgaggtgtttggagatggtatcactcaactcccagaagtgacatcccaggttatgttagaagatggtaagaggttatctgttgaacatctagaaagaacagaaacctcatcctaataactaaggttttacgttcaataccgcgcatcttgcaagtattctcttgtaataatgcttaatgaaatatgataaatttgtccaacaaattcccattatcgcatgttgagtatctaggtttttttacgaccccgcaatttgtatttttaccatgttctttgcaattttaatgatgtctaattatcttctgtatgttcattatcgatatttattagtcttcgaatttaaatccacgtgatctaatctgacgattcaccaatgatattctgtactgtggaagcttgaagcagcttaagcttccactgattggagaaaattgagattgttatgtagtggtccgttgtcttaattaaggacgtggaattggatgcacatacaaaataaactgtctgatattgcccgatgagaaccgaaacttccattcagaaattgttgcgaatggactgagactaacattaccatgttcacaaagtacgggttaactaagccttcagaataggtttttgtatattttcattacatgaacggtaaagtagtagtacctgcagaaaaaatgtacctgttttgaaagaaatagacatcgattatacacatttctcgagaacagaaacaaaaagaaatgccgttctttggacttctaaaataattaagatcgaagtttctccgacggggcctttactgaagcaatcagcttaaactttccagtcaaagcctccagatattatgtcgcctacaatttccttttcggttagtatcagtaccaatatcatgcagcactgataagaaccttgttttttctgtcggtcaaaatgtttcttatctgaaaagaagaagagtccgaaaaaactctattacgggttatctgacccagctcaaacctggtcgctctcgagcattgagatacagaacatgtcttcaataacactgatacttacttaatatgagtgggttgtttcacttaaattttcgcaatgataacggcaaccgttgaaaacctatgcacctctttctcaatggggtacagcaatgcggacaaaaacgcagcccaaagtgctattttgtcgtcataatagctgcgatttgttttccgccatcagataagaaagacagcatcatcaagcaatacgtaagatagtaaatactgagcaattgtatcatctactttcacttagatccaaagtcaaaagaaaaagaacgtacattgtctagactgagtcgaaattaatatatccacacattggagctgattataatcaaaagtagagcctagaacctttataatacgtaacgaatctggagatactggaaaataaagggctctcagaactagcaaatgttctaatcatgattatatgaacatagtattgagtagcaattccagagtaaaacgcgctcaatctgaaatctttaaatgtgtaagggttccagtttctgtccttgaacggttcgtactcaattctgattcaatatttgatatttaacgtttaagtatattttctgtgaggtaagtaagtaaccttaatcgggtggagagataagatgaaacggaaggcatcttgataaggacagatataattccctcttctttagaattgatacgtagtataaataatgatgatgataggtactcattttattatgcttcttctatctgggtaaaatgatcgtcaaaagagagctatttctaccagcattctcacaaaaagaataaagatcaatcatgagcgattcggtgtcttcgttgtctgacaagaataacttcgtcattacctcccaagaggtgaaaaatagagtagatgtggttacctctttgagaaccataacatcaagaagggtcggtgatgttaactatatcaatgccaagacagcccatgatgatacagaattattggctgaaattggatataagcaagaattgcaaagacatttctccaagactcaagtgtttggtgttgcattctccataatgggtttattaccatcaattgcgtctatcttaggagttgccttgccgggtggttccgtatctcttgtttggggctgggcaatttcaggcgcatttgttttagctaatgggctcgctatgtcagagttggcgtctgccattcccacttctggtggtctttattattacacacattactacgctcctccaaaggttaagaattttttatcctttattgtcgggaactgtaactccctagcattgatttcttgtctttgttcaatcaactatggtttagcaggagaaatattatctattgttgttgtcggtagcaatggtaatttcaacatcacaaatgcaaacacatacggtgtttatgcagcctgtatcattgctacggctgttgttacttcagttgctaccactgcagtctctaggttgcaaacgttctctattgtatccaatctactattgatatgcatctttttcgttgttcttcctgttggtgtcgctagatcaaaagacatggaatttaatgatgccgcatatatttttggtgatttcgagaatttgtcagattggaacaatggctggcaattcatgttagctggtttccaaccactcatttgggttattggcggatttgattcttgtcttcatatgtctgaagaggccaaaaatgccacagcttcggtcccattcggtatcataggatctatcagtgtatgttggtttttgggtttctttatttgtattgtcattgctgcctgctcctcgcaagacgtagctgcacttgtaaatactaaatttcaccaaccactagcgcaagtcttattcgatgccttgggtaaaaagtggactattgctatcatgacccttatcgcattctgtcagtttttgatggcagcttcaagcttgactgcaatctccagacaaatttgggctttcgctcgcgatgatgggttaccattttcgtcgtggataaaggttgttaatgttaagttgtcgtccccattaagagcaacttgggtaggcgcaggcgtcgccctggctattggatgtctatgtttgattggcccagttgcttcttcagctttattctcattgtacatctctgctaactacttctcatggatgcttccaaacttgctaagaatgacttacggtaaagatgtgtttaccccgggtgcatttttcatggggaagtacctctctccagttgtaaattggatttccatcatctttgaacttttcatgatactactagtcttctttccaactgaacagcatggtataactccagacactatgaactacagtgttgttttcattggtgcagtatggttcttggcaacaatttattatttcatttacaagcataagttctataaaggtccaaaatcaaacttgacagacgaggaatacgaggaaaacgtcggtcaagacgttcttgacgctatcttatctaaaagccaggattgggacaaaacagaatagacttctgtggttcccaaaaattgtatgggcatttctagccctccatttatgggagtaaatatcaagtataaggccaaggcccccataaattaggctaaactctactactttgtccacatataattatacattgtttgaatactaactcactctaaacccttgaaacacttgctgcgtaaattcttggcgaacttacttccagcttcatagaactttcgcacagatcgatccacattaaagtttgttttcgcctcgaaaaataccctttacggaacttctcgagactttagttatgacagtgcattgatcagtgtcttacttcatctcacaaaaagaggatacttgttaaaagaatcactaaaccgaacagtcatggtaattatccaaggacatcattcactaagtgttgtcatcttttattggtaacaagcatcaagaaaagaaggtagatctttactaagtgctaccggcttgaatgttacaatcgtttggtcatgcatttcaccacggtcgtaaacgctggttcgctcgttagtactccagaccaaattccaaatgctttgtgtgaatgtctagcaggttcgtctacgagcagaaatggaatcatattcataatactctatgagaacgcatcttgtttagttattcctgctcggaagaattgaaaatctttctgcattgattttccacgttttgaaggtgcaaacaaaacattggttgacgtatacgagttctagttaagagaaatcccaccggttcccttttcacagagtcactctcggtaaatcgtttcacccttcttggtgaactagaaaggcaggcaatactcggcgttagagaacaaacaatggcatttctagttcggatgcctgttcgttgttgcctacatccatttctgtgtcagagggctcgagtgatgcaaaagaatcccaaaaggaatgatttgagattactgtacgaaaaaaaatgacaacattcggtaatgtttttactataagagctaatgcttgggaaccggtaaaggtggttcttctttccgttaaatattggtggtcttcactctattgataccatgaacacgtcaagagtttgaagcaaaactacctcgaaacctaactttaaacttgaacaaaatggatccccttctgcaatttgttattgggttcctagtcgtatcatcaataccatattatttcatactgaagatcaaatacaatttcatcaaatggcccgttctcatctggtacctgttcatgcaggttcgcactgtgaaccgtaaaatggatgaattttaatattactatcgaactagatgttctctagagttgttattagcaccttgttaagagagtacaagaaccgtattttttttttttgacctacggaatatattatggaactggccaacattcagatttcgttgtaagagcttcgcttatgtggttagtaaactacttaaatattaaaaatcaagacatctggctttaaaatgtaggtttcctgaaagaggaccaacgaaaattcttggacgtcttgttcagagcggttaagtagctcattggcgttcagcagttcttttatgctatgtatttattatctatcttttgtcattgaaaatataagtagcacataataaatttgaaattatagtgtggaatttaaccttaagcatcgaaatgtttaagagtttatttgtgctcaattacaaaaaaaaatgggtaacaatttgatgtcaatgaacaaaaacttattccctattatttactggtaccctttgaaaaggctggaaactatacccaaaaaatactgcagtgcattaatcagtcgcggtgctcatagaaaagagaaaagacttaaggattcatgtagaggtatacagtgctaaattgagatattgacctggaaccaaatatctaaaataaagcagtctatccttcaagatagttcaaacctcgaatctgaattaattgctgtgagtaatttctctctcaatgtatgataattttgataatcaggtaacttcaataaattgatgcacgttgatgctgtgggtagtctatcagtttcatcaccagcgttacgtatcccaaataatggatttagagaatggaagcctttgagcggcgctgtggggacagaaaagacgaattttagaaattttcgcctttcttctggtgtaaaactactcagtacttgccagaaatgttggattgtgacgctgctttccgagaagccaccatatgacgtgtttttctttaagtcttcgaggtcgaaatctttctcagaaccactgattagggtcttcaattcatatgatgtgaacattctcaaccaatgtgcaggtatcatatacgaaagaccagtaatgaacctactggtcacagtgtataattgtaagttcaacttataatgagaaatgcgagtaatgtattcgaaaacattcttctgcgttacctttgtagacaagccatccttgattaatggtatccgtttaccatttggtgcatcaggaacctcaaagtataaatccatatacgctagctcattctctgacatctccaagagtttcatcaagtttctataatattcaggatctaaagaatatagatcattgaatggcacgttcatgttattttcaacgttgagaatcttcttcaaaaagaaatctgctaattcaacatcaaccaaaatattttcatataagcactttcccaaaatcttccccatgaaagaaatgtacttcaaattttggggggaaacattcttagaaggataaagtttattgaatgatgttgtgtcgaataatttgaaaggctgattaatgaagccttcttggactaacgtttgtaaaaattccttcgtgatacctccaccatctataccggcctcaggaccgaattcattcacaaattgtattccgagtttttctttaaacatctcgcctaccgcaccgtaggcattataagcatcttccaatgcgtgctctctccgtatggttgatcttaacctattttcaccaggaaacacaccaaaaaagctgttacgactgtaaattctgatcttatcagcctctatcaaatcattaaaatagtcaactctttcaaagaatttgatcatgaatggaaacttaaataataactcaagtttccggattttactagaagatccccttcttttggattttaaatcgtccaagtactgtcctttgatattctggtcaataaactttttcttgtcaaacatctcgtcctcatttagatccatctcctcgaagcgtaccaggtacgctctataatactgctcgaattctaatatctcttttttgatgtttaagttatgcatttcctcaggaaccaaatcccaaaaggtgcttgtccctttcttgaggaattgaaccctagaatctaagtatatgaggttccacatgagttcgatgaaggtgtctagttcctgggaggggataaaggtgtccgagcccaaaatgcttgatattagaagctttgcaatatttattgaaagggcctgtaatcgatctctcgttattatagtcttaaatagttgatcatcaggcgacaatgggatgtaaaagtttagcatttgggaacaaacagagaacgcattcaaattagcagctacggaatcatcacagagtagttcaagaagatcatttcttatatgagtgtttgtcaatattgacatcaaaatagaattgcgctgcattgacggaagttgactcaaaaagaaatgaatacctttccaataggaagaagactcttctttgagccaatcaaaacaatttagtagagattcctgtagattgtcatcaataagcctgacatcgatactaagtggttcatttagctttgaacatatgataacgaaccatgaggtgtggactgatagagtagcttccttgatacccttgaaggctgctaagaaattaacaacgtagttagccatatcatctttgttgcgatccaatgcacattgaagctgcggtttcaattctgacgagaatagagcacttatgaataataaataattctccttcttcatggtatgcaggcttgaaatgaaatataaatcattccaataattttcatattcaccgctactgttgcaggaaggttgtgttagtgcactgagttgttcatcagtaataaggtaagggcagttaagaacgaatttcagtttgttatgtatatgagtttcacttgcggctggtgtgtcaagagatttcactgaacgcatgagtattgtatctaactcttcagaagtctttctttcggacacatcacctagcatattactgaatagaaataatgccgaagagtctgcaaccgtacgattgataagatacacaaattcattgggctcaaggtatgcgtatagccttttcgaaaagactttcaaaatcgacgccgcggttttatccgtcaaactttgcttaaccaacctgtgaaatatcaaattgttggatattctcttccgcatgtatctctgaatcgtcaacacagcattgatttccgccctttccctttgtcttctagccctttccagttcagcgttcttcaagattgtgtccctagtttttctaggggcccttgatcccatgttaacatttcgccgagtaacctggccattgaagttcatcatctttggtcagtgagtttgtgtatacaatcttttgaaagcttattgttatcaatggtttatgtgtaaagtcttaagaatcaaggtattttgtattttgatgtgaacaggaaattatattataaatactgtaattttccgagtgggattaataccacaccagacataaaataagggctcgaagagcttgatgctagactaggaccaatgagcaaccaagtaccacttaaacgactttttaaagtcatacttgtaataagatgtgtccaagcccttttgacccgaacattctttcaagcagatgagttctggcagtctttggagccagctcattacatggcgtttgggtatggcgaactaacttgggaatggtctttcggcttacgaagctatgcatttccgcttatatttcagatcggctatacactagttaaatatgctgcaatatcttgtgaattgattgtgcaaacagctactgattgggtactgctatttgttgccaatgtaattccaaactctgagtttgggtgggagatggtacaggagatgagaagtttcccagaagaaatacgagggtttatcgaataccaaggagtgatatatgcacccaagctaataatggcggttctagcagcaattggtgagtttcacgttattcttttagctgaaaaattgtacaagttgaccatggataaaagcgatgacagcaagggatctgacaagaagcattcaactgttataaacttcactttagtagcgacagttagcaactttttcaactgctttttcattactaggtcttttatcaactcttttgaaatgatattgacaagcgtgtcactatattattgggattggacttccggtgagcatatagaatcattcgactttttgaaaagtttgattatcgggacatttacagtgttacaaagaccaacaaatgcttttatatggttgattttaggaggatatatgatattgaatcttgttctttcaaagaggtggagaaaacttttcagtttattaattaaagtgatctgtgcttcattcatctcgattagcacaaatttatgcatcgattattatttctacggctacatcacaattccggtgctgaaatttatcaagttcaactgcacaagttcattgtctaaattttacggagttgccccatggaatttccatgttttccagagtttgccgattgtggctggttactctttaccacttttgattcattcgtttttttgttcgttaacaaagaagagatttctttctccccttgtcaacccatttttgcaaatcaagacagttgtactcttgaatgtcatactgtattctctaattcctcataaagagttccggtttatatatcctttgcaacctttcttcataatattgagcgtattcgatgggatttggttattgcaaaaatatggctctactgcaaccaccagaactatggaattcttctcacaggtaatgtggatattgcctgtagtatcaatggttgcttctatgttgctatccacactacatgaatcgggaaccgttgctgttatggactatttgcattccatcagaaatattgacagtatcggttttataatgccctgtcattccacaccatggcaaagtcacttccatagaaatgacgtgaaagaactgtgggctatcacatgtagcccacctctacatcttttgaccgacccagatgctaatgccaaattacccttttacatggatgaaagcgattatttgtacgacaatatttcgaaattcatgtaccagcatttccctccagtgtttagaaaatcacttagatcgccaggaaaacaatacacctacgaatggccggagtatcttgtaatattcgaagatttagattcacagttcatgaatgattaccttgtcgacagcatgtacatagaggagacaaggtttttcaattcgcttgtgcattgggataagaggaggtcaggcgacataattatctatcataaaatgccttgaagctgatgcaacaagtaataatatttttgatttatctatatacagtaaatgcaagatgcctagtagaatacttcatagattccatgtatttgattttgataccttaactgtggtgtcaccaggagttaaactttgccaagtatttatggaagcatttgggctatactctttaattttttgaatatctgatgctctatgggagctgaaatcctcaaagagtcgatttacatcttgattgttttcagcaagcttttccatactttcataacatctcttagccagcaataattcattatttttcattgtacaatcgaaatagccaacgaaacattcagtatcatagagttccattcccaacttaaaccattcctgagctttggggtaattcttgaagtaattcatttcgagcaaccctagtgttctaaatgattccttgaagccttgggtggcactgctttcaattaagtacctggctttaaatatatcgttattcacatacatttgtcctaacaaaaagtacgatcgtaccgagtaatcaataggacaaagtttgattgattttaagaaacatttctctgcttcaataagattcggttttctaaagtggatctggcccaattgaccgtatacttctccagctaagaaagtatcattctgtaaatccaaaaatttcatatagtacacttcggcagtagcatcgtcatggttcttcagagctatatcagcagttagtttgacggttaaagggtgattcatttgatagaggttcttaatcaatttctttgcatgagatacgtcatcttcagtattactgtctggatcctttagaacatcaaaacataagagcgatatagcatcattgtctccgatctcagcagccctatccaacaaaacattctccaaggctaataggttcttgttgatagctttagtcttatgcctcactttctcaagaacttttttcattatcattaagtctttccctttgatgctattgggtatatcaacatcattaccagtgtctagtccctcataaagcttctcatacataggatatagcttattgtatgcaagccgactatcgagctcaaacaatatcctgctaaccatcttcttttgtgggaagatctcatgcaatggtggccgtttgttggctaaactggaaatcagtctcctgcttgataccaagatacagcttctaaaaccaagcatctcgaacaaaaacagttttagctctcgggtatatcagaagattcgaataaagcctggaagatctcacaaaagcctaacgttctgcttaatcctgtaggtctgcctttgatccatttgtgcgtaagaacttgatgatgtatttggttttgatcctttcctggttaaaattcgagtttctataaaatgattctttaccaaccgttacacataatcggataaggtccgattatttaagttaaaggcatgaaagtaggtgtcaatacacaatcaatatctatcaatggtgctaaaattccaagctaattgtcgctctttgattcgaccattgttttcacgtttttattcggctcctgttgattattcgcatgctgttatcggtgcaggtgtagtcggactggctattgccaacgaacttaccaaagtcccaggcaataaagtgattgttttggagaagaatgcaaagattggccaagaaacttcgagccgtaatagtgaggtgattcatgctggtttgtattacccagtagattcgttaaaaacgaagttttgtattgaaggaaaccatatcatatacaatgaattgaatcccaggaagactggtgtcgattggctgaaatgtggtaagtgggttgtggcacaaactgatttcgaagatgcatatgttgaacgtatgtactataaagcgaaatatgagttaaatcttccagtagaaattttgcccagtcacaagactcaatggcaagagccagctgtaatagtcgaaagaagtgcacttgtatctccaaccacgggtatcatcgactcacattctttgatagaatacctctctgctatggttgataaccaggggggtgatactgtgattggatctgaagttaaggatattcaatttttaggatctagctacgctctccaatgcgtggaaacgctgaatggtactgcagaagaagtcgagattcgtgtagaaaatgttatcaacgctgctggattatatgcagacaagattgctaatatgatcttaccacctgaacgtcaggtaaagcaatattatgccaagggcaattatttcacttcgaagactcaagttccagctgtgagaagattgatctatcctgtgcctcccagaaatggcaaatcattgggaactcatttgaccattgatttaaatcatcaagtgagattcggtcctgatcttgaatatgttgactctgcggatgatctgatcccaaacccgctgaatattgaagacgctgccaaaaccatcacaagatatttccctcatctgcaaccaggtgaattagaggcttcatactgcggtatcaggcctaaattagcagcaccaggtgacacagaattcaaagatttctatattaaagaagaagaaggattcccggggtttgttaacctgctaggtatcgaatctccaggtttaacgtcaagtatcccaatcgggagatacgtgaagaagatacttcacggttaggaataacagataacatgcaataatgaacttttttttcgtacatatcctcgtattctattcaaaatatatctaggtattttcatttattgagcttaggaagatcttgtggaagtgtaggctccggcaattcctggaaatattgactttgtagacacttgactgcatcccatctctttttagggttcattatcatcatcccacttatcagttcaagtgcattttccgtagccgctatgaatcttcttctcaattcctctctcgatggaggtggatatatttgaatcttattataattgctaaaactagaaacttcaggccaatccgcatcagtaggagttcctaacgcacggaatgttacgtttatctgatcaacatcatctttccccggcaaataaggaattctcaacattaattctgcgaatataacaccgacagaccagatatcgaccgcagaggtgtagtgttttgcaccaaataagagctccggtgctctgtaccatctggtaacaacgttactggtcaaaatctcctgtggtgacgccattagtctggctagaccaaaatctgcgattttcaattgaccatcaggtgctaatagtaaattatttggcttcaaatctctatgaagtatgaagtttctatgacaatggtgtacacctctcaaagtcattagaatccaggacttaatatctgctggactgaacataatagaagtgtccttaataatgatctccaagtcggcaggtagaaactccaacactaaattcaaattatcgtttgccatgaaaacgtctactaattcaataacattcacatgcttcaactcttgtagaaacttcacttcacgtaatgctgacatgtcaagtccatctttgaactgtgaggtcttgatctccttcaccgcaatactccttccagtggacttcttagttcccaaataaaccacggcatacgtaccttcaccagcctttttctccttagtatagtcatcaacagtagattttagggtcatggtttataacttcgagctctaccgtatgacagaatcagttcccagatccaacgatgactttaaacatcaaatgtctatctgcatgttggcagaagcttggacctttctatattaaatatgaaaaatctttgaaagtttgatacatattatgctatgtaaaggaagaagtgtatggtgaatcaaaacgaagtaccatcggatcttcagagttaaaaactacattcgattggggaaatgatctcaaaattgtttggaagaggaaagttctttcgaaacgtggctcttcaagtcagatttaacagttctgaagccgtcgaatttcgaccattgcactcatcgctaatatcaagagcagagctgtatgtcaatgaattgcgagagttagaggacctgttgtcgcagggtggatccttcgatcttgagaaacagaagaattttgccaaactatctacgattgtggattcgtattccaaatacagagaagaagtcaatcagtataaagaactacaggagatactggaattagatccatcattacgagaagaagccgaagcagacatagcagcactactcccagatttgaacaagacaggggactctttattgaataaactcctaccgcctcatccttttgcagataaacccagtatattagaactaaggcctggtgtcggtggttctgaagctatgatattcactcaagatctgttgaacatgtacattaactatgcaaattatcataaatggaaatggaacctaatatcaaaaactgagaacgcaagcggtagcggagtcctggaagcaatcttgaatatagatgaaccaggttcttatgataaattgaaattcgaagccggagttcatcgtgttcaaagagtgcctgccacagaatcaaagggaagaactcatacttccactgcggccgtcattgtgctacccaaaatgggtgaagaaagtgaatctgatgcatacgagaggactttcaagccagatgagattcgtatcgatgtcatgagagccagtggtaaaggtgggcagcatgtcaacactacagattctgctgtcaggttgacacattatccatcaggcattgtgatttcaatgcaggaagaaaggtctcaacacagaaacaaagccaaagcctttgctatcctacgagcaaggttggccgaaaaggaaaggcttgagaaagaggagaaagagaggaatgcaaggaaagatcaagtttccacgacagacagatctgacaagatcagaacttataattacccacagaatagaatcacggaccatagatgtggcttcacactatatgatatcgagggggtcatgaagggtgagaggctagatgatgtaattgatgctatggacgcgtttagttctgagcagaaggctaagcaattacttcaggacatgtcagcttgatcaaatattcagttggaaacaccgttctgcgccagggaatgataattggatttacactgtaaatagtataaaataaagttgcatatatgtatagaagaaagcaccctgaacatcaatctagtgtgaaacctcactcgagggtacgtattggtgtatagtgtgttgctgtttctcacccagttctttatacgaaccattatacgatttttgactggagaaattgaagtgtcaaaatgcaaagtatgcttagatacataatcccttcaacgatgagacaaaatgcaaagcaccaacgggatcagtggttaaaaatgactgcatcagatcatgatatcatgtaccatttccagtcgtcgttgcgaataggggagctagagcgatatattttcacttatgacctttatatgggagatgagatacccagtgatttaacgttggattcattgtggttgaagatcaaaaacattgaaaacgtgacgctcagggcagcgtatttgatggggccctacgtgttgtacgcggatgtgcgaacgaaggattaccaccacaaacaaagattattcatttctgctgatcaacctcagtttgagtctaatattcaaccgcaacaggattttattgcggagctttcattgcacaacttgaagaaacggtacgtatggattgttgacattgcaagccaaatcttatttaccaaacaggcatcgataaacttttctatcaccgtaggtggtagtaaggaatcaataagtgtggactcagcaagaaatatccagttgggggtacagagttcaagaatgaaagtggatagactgactaccgcagatctttggaatgcatcgttgctttcaaagagtgtttttggtaggcgaaaagagcatctcgtcattcttacgcatggcttacactctaacgttacgtcggatttattttatatcaaggaacagattgagaagactcaaaaccaacatgaggaaatgctagttgtgaaaggattcaccgacaatgtatgcaagacagagaaaggcataaaatggctagggacccggttggccgaacatatagttcataacctatacaatgatgctactgtaaaaatttcattcattggacattcattaggcggattggttcaatccttcgcaattgcttatatctcttacaactatccaaagttttttgaacaggttgaacctgtaaacttcataacaatggcatctcccatgcttgggattgttagtgacaacgcagtttatatccagcggctattggcaatgggtattgccggtaagacgggacaggatctcagcctacaaacatacaatggacttaaacagcctcttctacaaactttatccagctcgtctgctttgagaaggattctaaaatgctttaaaagctgcacagtgtatgcaaatgcttgcaatgatggaattgtaccattatacacatccgcactattatttctagattatgatgatattttggataagcttaacatgaatactgaagatttacagacagacttctttcaaaggaacttcatctctccgctaactaaggccatggatatattgatgcctcagagggtctcacaaaacggaacaaagatacctgtggcatcgatgcttgattctgcatactcagtattgattcctccactacctgacaaatcttatataactgatccgaaaacaaggaaagacgttgtagtacatgataaagtatacagcggacaggatattccagatcatcaatctaatagccaattggaggtcatgaatagctcaaatgttctacttaaaacatttaacatagcttttggcgggcagtataaaaaattggaggaacaaatagcaagaaattggcataaagacgtcaaatggaggaaagtcattataaatttgaagcctgatgctcacaacaatatcatcaccagaagaaggttctctaatgcgtacggttggccggtggttgatcatttaactgaaactcacttcttgaatgacgataaatcttcacgatcatggaaactggatcctatctcgaaggacgaagattttgactggattgtaaagccaacggtagatagcgtattcgacgtaggtccaacgggcatgatttgtacttttggggaaatgttggaaaatctgaaaacgtccacactggaaggtatgaccgaaagcactgtgccaacgtcgtacagccaggaagaattgtttaaatatgaagactgtttggatagggatggcggaatacttccttaattatttatagaattttgtataatgcataatctaattcagagttagaaatgtattttaagcctagtgcatctctcacttcaagatagtcttgggattgtgacatatatcctttactcaaaaaaggaagtacttgagatttgccgttgtactttaggcttaagactttcatgaactcttcaaattcttcttcttgaacacattgtggaacatcatctagttgtaatacagttttcaactctccataatcaagcatgacttgttttaatccattttcagagaagttattaactttgacaacgtagtctttcaagtaaaatatccattgcgtaagtaaaccatggaaaatggaaatagaaatatttgttggcaactttaacagagcaaattcagccttaagcttggatgatttctggatcgcgcctatcaactcagttgaacattgagccggagggttagaaatctcctgccatttgctgagtctaaagtagggactgagagaggcttttaatattttcttccacctatgaatgattgattcccttactgtcacgactgtttcttccagagctgagaaggattccgtaaagatacttggataagtcgagttactcaatttgttgaaaatatatgtcaactcaataaatgctggtttgaagcgaagttcagacacacattgttcaagaagaactatattgtgtagcttcaagaaagtgatttccagttgtttttcttccggaagcaatgataaggctgggtctggcgatattatgaatttgttgtacctgctcacaagctccaagaatattctactgacgatctggagcttgtacgagtttagatgataataatcgatattgaaacaaggttcaaaatattgatacatgctttctaaaagcttcaccaaatcggcaccattggtaagaagagcagaggatacaattttttcatattgatctagtgtggaatccaattcaaattctaaccaagcttctaggacttttgtaggtaacaaggacactaaaccaatgccggtgtaataatgttttttgatcaacgcattgtcattaatgaaaatttgggatattaggacaatcattgtcctaaggttttcattcgtttgattttccgatatatttaacaaagtttgggtgattttatttcttattggattcaatgtatggttgatgaattgctcatgaacgaattcctttgtgagacctgacttttcatcgcagaatatgtcgatacagcgaaacaactttgtttctaaatatctatcaaggaatttgaaataaagctcgatactctgcttttgctgacctgaatcctcaaactttggattggaaaaatggtacatgaacttgattaaaaagttatgggagataccttggaaattccaatattgcctattttcattatcatcactagaatcatctaaccataacgtctgtaaattgaatagtgttgaagattgctgacgaatatcgtgtatgattttcttggagctgacaaaatagtctgtgtcccatttactgtttaataagtcttgtttgaacttttccataagttccttagcaatcgcttcaagtaaagagttgaatcgcgttatcacttccatggattcaattccaagcgatactattcgctgtttcaaagttgagagatgctccaagtcaacactctgtagctgctcagtcgagactttctcaatttcttctatcacctcagtttcatggcgaaacacttccttttgcctgaacaaattttcaatctgatctaatacttgcaaacgaccgtacttcaatcgtagtggttctatatgtgctatatttgaaatcgaagatatttctgccgttgcatcatctagccttttctcgataagatccatttggttaatgaaatcatcttcctcatctttcaactgtttcagcctttctgctaattcatctctttttgagctcacctctttaatgtgcgaatcaatgttaataagatcctggattgattgcagcatcttgagaaggtgcgttgctgagtataacaagaataatgggcatcaattgttgttggatacactcagtaagtccttcaattcacttcattccttccaaagaagctgctgttatatctctgtcaggttccgaaagtctccaatttccgggtaatcttatttacctcataatatgtcccgacgttgagtaactcatccttgactacaatgctggctaaaggacccatccatagtccaaatatacagggattgaactgctgtgaaactgctattttagagagataccaccttatcaactgctacttttggagggtttactgttttcccagccggattgacgataaaaacggtaggattttctcttttcggtatggggaacgaaaaatgtactttttcagaaattacgggcgtgtggcgtagttggtagcgcgctcccttagcatgggagaggtcttcggttcgactccggactcgtccattttcttttttgtcttgaacgacaacattgcattcgaagcgtataaagaccttccctccaagctagtagttgatgcagtcttgattttttggacgcttcatcgacgtgaggaagagtaccggtttgtgttggtcagcaatgttacaaacgggattgaaacgatacttatgaaaggtatataaaagtgcgttaatttgggaggccgccgcgggaggccaggacgtggaaaccgttactattatttgtgttgggtagtatcctgcggcgtaggcaaatctgcatcattctcactatcactttctttttctaagtctatctcttccgcttcttcctcgtcttcctcgtcttcttcaggtcccaaagattccgcttgcgattcaccctcgtcgttcttaacgtcagaagcagtagatttctttggatcccttttcagtttcttcttttcaggagcagtttcctcaccttcaccatcatctacatcgtcttcttctgcaagatcttcttcagcgtcctcatctgcctcttcatcctcatcctcatcctcctcctcttcttcctcttcctcaggctcttcttgttccggaggatagaactcttcttcaccctcattatcccaaacgatattaaacctagtaactcttggtttctcagcaaggatatttctcaccacatgatcaataggcactttctgaggtgggttctctctcaattcttccaaatcgtattcgttgtttacgtagtacccaacccttacaaactctttaccattataagagcacgatagtaaaatcacagtaacactgaccaattcactagcaggaatcagatctggtgaaggtgcatctgccacgaatttgaacttgttgataccaacgggtataggacccaccaggatagaatccaattcttgatcatggtcaagtgatctagaagaaccaacatacgtcaatttccattccaaatcgtgttttaatggctcaagacattcaaaagtgatttcaaattcataagggtctgtgaacttggctggattgttcaataccttgattcctaaaagtgatacaatagacatgaccgaaaaaccgctgtaactaatataatgatccctacagtaactctcccgatgccttgatacgtagtcactggattaacaaagcttgttcttagagcaatgcttttgttaaggttatgtgatgtgatgtataatctttttttctatctttatattgaatagttgaaaagtttaaaagaaagcgcgtcgcgtgaagttttcaatcagacaaagaaaaagaccggtaggagagaacgttgaatcaacaagggctgctgtaggttgataacactctaacaacagtagctcgataataatacgatcaaaagttttattgaatgaaacaaaaaaaaaaaaagagatatagaagtgaatatacataccttatgtaaaattgaagttcaaggtgaaggaagatgcaatgtagaggggaagccgcagcacggccatttccccttcttttttttttgttacaccgtcaacgatgtataagtattagattcttgtacgaattcttgcgacaaaggtcttccattattgagcgagccatacgatagcacggccgcagaggaagtagacgatgatggtgaatgagagccatccaattcagagagaaacttcgaatcgtgaaccaaagattcttcaaagtagtagatggatgcagaaatgcgtaccactccgatggttagcactatgaaaccgaacacaagccctgtgtataaaatctcggctgtatgcggtaccaatgaatcgtgatagaacattgtactgttcaagattgtagtcaaattatagatggagaacacaaacggataaaggatcgatgtagaaagatgagaaagccctgcgttcaacaaatacaactgagtcaacgagaaagttaccaataccaaaacgagcaagaccatatgtaaagagatggaccattcagtaacgataacgttcgacacgcatttggcaatgagtaaagcatgagctgaccatataccactagcaaatacaagcgaaaaccctttgacacgtttcccgacaccgaaaacacccaccacaatagacatgatagctaaagcgttggtaccgacaaaataacgaataaatttttcactttgagccaattcgcacaactcttcaaacgtatgcgtcaaaggagtgtttatgaacatacatgacattgaagccatgatggtaccaccagcacaaacaaaaccagtgggaatcagggggaacggttctcgtagaagcatatgggaaaataaagagttgaaaaccaggccagatgcctgtaagggagccaatacgatcaagggcaaagtagctatttgaatgacacaaccgaataaattagccaaaaggaaaagcgaaaaccccaattgccatctcttattcctataaacgattgatctaggtggtaccttcagttcagaatgaagggaaagaagttccgaattattgtagtggaacatttcaatacattcagctttccgttggaaaacgagtcctaatgcctgtaaggcattagccacgatagcagccacgactcctagcagaaccacggggggcatcttgtaacctggcgaagagaagagaagacaatataccttggggatgaaatggtatatggtataatatgggatattaaatgtgtgttctgtatggtttggttcagtacttttgtacttgatctggaacgagatatgctaatactgagaaaagatgaacaatgcgagatgtgaagtgcaaagcaatgaaatggcagttgaaacagaggaagaatagagtcacgtgagtccgaaggactcacgtgactcccacccctcccacacagccataattttttcgtctgaaacactacggcagacggatcggcggaatttcccattctcttaccatacccaatgcggaaacttgtttccgcattgggtttcctaagtgcaacaccgtgttccttcacactgccacgcagatctctttccgttcctctttcggaaaccagttcctacaaaacacccacacactccaatctatatttccctactaccaataccagatcatcttccacgaccgtagcaaaccttttcctcctcctccgtattgggtaacgccatttcccgatcgggccactgccactgacaacaggggaaaatacccaaagatctagatctcttcgcctggaatcgacaaaaagaaaccgcaattactttgccattcgagccaaccaaaggaccgaaacaaaaattcaccgaccgctatgtagaacagccggcagcaggacgaaaaagaaagcgcaatgagatttccgtttttgtctgaaacagatactttctgttacttgattcgatttgatttgattcactttgtcacagttttactttttcaattttggcaatggatctggaaacaggaatcatagattattactgtttatattttataacagtatatatatatatatatatatatagagaagagatctacagtacggaaagttgtttcattagtggtagattgattgatttactttgatctatttgttttttgtagttttatagttcttctgcctttcttacctcggtatccatcaaagatcagatcattttagtatcccaactatttgccattccttattattatcatttttcaataggtaattcgtttctagaaactattgattaatattacattcacttttctgaccctttgtcgttcattagatctgatatttcgaaaatggtttccactaaatctttgtttgtgtttgctttgagtgcttctgctgcttttgcggcccctgcgccaggttctaagcatatccaccgtaaggaaaagagagctgctgtcactgttactcagtactacgaccaaaacggtaacgttattgctgatcctaacgctgttgctactgttccagtcgaagcagctgctatgcaggctgcttcagtggttacttctgctacttctgctgcgcagacgactttgagtcctacttctagcgctgaagaagtgacttcatcctcatcatcttcttcatcctcttcatcttcatcttcctcttcctcctcctcttcatcttcttccacttccacttctacctctggctccagctccggtatcgatggtgatttgtctgatttctccggcccaagtgaagaattcgaagacggtaccatcccatgttctcaattcccttctggtcaaggtgtcgtcgccgttgactggatcggtttggacggctggtccactatcatggacatggacggtgaaacttctagctcttgtgaagacggttactactgttcttatgcttgtcaagctggtatgtccaagacccaatggcctagcgaacaaccaagcgatggtaagtccatcggtggtttgctatgtaagaacggttacttataccgtacgaaccaagattccaaatacttgtgtgaatggggtcgtcaatcctcttacgccgttaacaacaaggactctgctatctccttgtgtagaactgactacccgggttctgaaaatatggttgttccaactttggtccaaccaaactctaagaagccaatctccgtcgttgacgaagattcttactacaaatggcaaggtaaatccacctcttctcaatactacgtcaacaacgccggtgtttctgttgaagacggttgtatctggggtactgacggttctggtgtcggtaactgggccccagttgtcttgggtgctggttacgtcaatggtatcacttacctgtccatcattcctaacccaaacaacaacgaggctccaaactactccattaagattgaggctgctgacggcgcttctgtgaacggtgcttgttcttacatcgatggtagttacactggtagtggctctgacggttgtaccgtttctgtcacttctggtactgctaacttcgtcttctactagatctacagtgtagaaacagatcaattttttttttcccaacgcatctcacagtttttatcccattttatggttaaaaagagagaaaagatataccccttccccccatttcattcactcgctttatttctatcctcttcttttttgaataacatcaataccctttgcacctttattcctcaaaaaaaatcaaattaaagattactatttgagttctctgttttctatttttccagcctgcatcatccgttcgttatatcaattgacgaatccttctctaaaaaagatattcaaagaactatttgtggatcatttagagtcacacatattgctactctaattaaacaaaactactctttttttttgcactattctttaaacgtcatttacatgtttggaattcaaacattggttcaatcatattttgatacccccgaactcacatgcatcattttgctgcactgaatcaacttaaagttctttgccaatttccctaaatttttttcattgatagaattttgtcctacagattattttcatatttatgggaggttctcttttcctcttataatgtacttcaccatatcgtttggttgatgtaaggtttttttatcttttataaaaatggtgggttgtataattatttcttatcaattaaggttttctatttaaaattatttcatcctttctaaattcgtgcttctttgctcttctttattcaactaccggttcatgttgagattcttcctctggtggggcaataaatgttccggccaacgctagagcaggttcgtcaatattatggtgtgcataagaaagaactcccataccaccagcatccaacaagaagtttggattatcaaccaagtatctgtacttttccattgttacattaggaacagtctcatcgttataagtaggttttggtggatcgaatgatggttcatatttttcttctaatccatgtttgatccacaaggatgcgaaataacgtaatgcatggccatgtgcaaacaccaagatatcacttggtactccgtctttctgttgttggcgatgtaggttttgaattctggaaatgacacgggaaagtctacaaccgatttgcttggtgctttcaccgttttcacaaccatcacgccagatgttccaaggcctttcttgatccaaaccacgggattttctcaatttgacaatttcatgggtcaacagaccctcgtaatcaccatattcccattctcttagatcgttatcgactacgattctgatctttgaacgttgttcttcagtaagggattccaaaattaaatcaacagtctttctagcacgttgacgaggagaagtgaaaatgtatgtgatatggtttgggtcaatgaacttgttaccaaagacgcatttaccagttcttctcatctgttcaacaccatatggagtcaacggaatatcagttaatccggtatattgaccggattttgaccattcagtttgtccatgacggacgataatacaacggggagtaactttagacattggtaataagtgtggtctgtcctctaacagctatcgattaagttgcacacagtgacttcacaggtacaatccagggaccttatagatggaactttatgaccacgtattccttccttctctttatatctcatattttttccgagccttgaaatgaaaatagacgatgcttggcagacaacatcagttggtgtccgttgctaagaaagaatacaaaagaaccggatacagaagtttcaatgctggaagcgtgaattatatttatacacattatgtaactttactagtagatcgatgcgatagtgaattggtacatgtacatacccgaggcggtattagaaagtgagaagaaaataaaaaaagtgtccgttgatagtggaaaccgaaagatagagattgggagttttcacagtgttcaatccttctttggttcaaaatggaattgaataccccatagctctttcttgataccaaacatagttgccaagaacttattttcaggcaatttgtaactttcgatcatgctaaatcccttcttggccaacgttttctttgtatagttttcaaaagaatatacgtccactagcaatttcatcgattctccgtgtttgaattgcggatgttctttttgatagttcttggtacgaatcaacgcccaatcgataaggtcttccaaaatcccactcttcaaatatacacgacgacaacctatcgtagaaacacccataaccaaagcgtccttcttactcaatggcttgttctccaagaccgaaacaacagcaatgggcgtgtcacggtacacaatgatctcagtgttatccaacaggttttcatcctgtggttcgccacttgccaatttcttcaaatcaatgccgtagatgatttgtccattggtatccaagatcaacttggatttcctcttaaacaccatttccgtaatcttagacaacaaagtaattattgtagacccagtgatggcccataccaatacacatgtcaccatctctttcttgttcatcaacataaactgatacaaccacccagtcacgtgattagcatgccctggataattggattgcgttgccaagtacagcaacccacatgaaatcacggtcgatactgtgagtggatgccagaacaaatgcctatttagcaaggcacattgctgtttaataaaatcaacagcaagattcaatgaagcattagcaaattcaggttttaaagaagtaccatagattgtgggaggagcatcctcatcaataggatcgttcaaatgagcatcaatttgctttatactgaccattttataatcagaagatcacgccttgtcagatgtactactaccaaacaatataaaacaaatatctattggatagtatagtgtgagagaagtcttttgtattttcaatcctaataggtaagtgcaatatacatatatatatatatatatatatataaaatatgcactgtctattcgttaaaagcgaagttatgtttgattttcttgagaaaatcaatatatccagaaatcgaatttttcaacatttcgaatacacatggactacatatcatacacatggacttgccaatcaattactaagtacttgggtgtggatttctgtgggctgtacctgctcttttttatgcagttggtttcggcttgtacaattagtgcatctgtgtgtgaatgtactgtgtatgtattgtgtatgtattttcaccgttttacatctcgacgatatagccatatattacctttcattaattccatttagtaaacgtggaattaatcacatcccaggagcgcaagaattgaggaaacacggtgtgtgtgtgtgtgtgtgcgtatgctgcaatgcatattgttctttcttttttttcagtcacgtgcctaagaagcgtaattaagatcgggtgttagatcttcatagcgggattggcccgcttcttgagtcgactgtcgcagactcattcacaagagttttggatatactcgtatgcgaatgcaatcatgttcatgtatgattgtgcagatatagtctcattcacgccgtgcacatggccttccgtgacagagttagtagttgaaaacctgtaacggtagatattcttggttagattccaatacttggcagtatctgtattccccgtagtgatcgatggggaaacgacggctttggcacctgggtacgtgatatcttcgaggatatgtctaatggtaccggcaaaagtaccccaagcttcgttaccatatgtaggcgatacaggtgccggttcaaggcattctgatgtgtcaaactcaaaacttccgaggccattggcgtcttcgatgacagtttcgcccttataggttaagccaactccgtatttcttggcgatagtctccacttggtccatgattttttgttcagtgtcgtggcaattggatccgatgttgattctatggttaatgtatagtgtagatagttctggcaaggcgttgattttgaatccgctatggaaaatatcagctgcctgcgtagtctttatcaaccatttgaatttgtcattaccactgacccaatctaccacatggtcccttgcatacttgctgtgctcgtaatgacggattgcatttctggggagaccgatatcgtcagtgtcagtgtgttctaccatacagtacaaatgtttcaagaacggattttccaaatggagggacggtttgaatggattcgtctctacactatggatcaaatcagccattataccaataccagtgttttcaggaggcaccgaagaatgtcctccctttgtgttcaactgaattatgctgcttaatgaacccttttcaccaactgccggtaaagcgaaataggtgtcaccaattttctctaccgaacttccaccctcatctacaatggcatatatcccgtcagtgccatatttgtccataaggtgctcgtttatggtctgggcaccatatccgccaccaacttcttcgtcaaatccaaatgccaagatcacagtacgctttggttggaatccgcccttaattaataattccactgattcaaaaaccgaattgaccaaagctttgcaatcagcaacacctctaccgaaaagattctcgccatcaaacgtaccattgtatggtggatacccccattgatctatggtttctgcattgacaggcacgacatcttgatgtcctgctaaaactaaaggctttaaactagcatctttcccctcccaaacgtaaaccaaattgtatttgtatttagtttcatcaagtttcaaagtcttatgcactgcagggtacgtcttacggaaatagtcatgtaacactgtgaagttttcatataccttaggaaattcaataggatctagatgagaatcatacgattcagtaggaattctaacggatcctaatagtttctcaacggcatcgctacgatattcgacatcgtgtgtgatcatttccaaggtcgagttatcattgatgtatgaaggcggtttcaaatttggtgcgtttggacacaatggttcacttgcagtctgattatctttcaaggtccttgaccatctggataaatgcaaaccacataaaaacaacaaaactgtcaccacagccaaggcctttagccttaaattagaaatatgaacgtcacgattctccttaatacccattgtttactcgataaaaaccagtcgctctttctacgataccgtttacaacgtcaaagcttcaaattctgagtcttctctctctttgctgtaataatagcacaaacctcattaaggatatttaatttatactagctgtacataaatatatctggtcgaaactcaaaggttctgcattgccaaaagggttatataaaagaggacgtggggtataatataatagaatataatagtcttgattagtttgtaaaatataacgtacagagccagccatacagagttcttgaatattttaaagcttggtgtttctcctgctgcttagtcgatatcatagtttgcatcgtatccttatctattatccatacatagtgatagaggccgagggaaaaagcaacaaactagcttcttggaaccacttggttgcataaatgacatttaagaatggtcttggcagtgaaaaaaaaaaaagcacaaacaaacgcagaagttgcttctggtttcaggtagagagacctttcaaacctttgacggaggtttctgtgtcgacagttgtatttgactcatcaccgacaccgttgtacttcttcaatttttcaatggtcaatgaacccaaatctgaccctgtagtcaagatagctctaggaacggattcagtttccttgaagttcgtgtcgtatttatcggaaacagtcttgtaggcagttgaatatgtttcctttgccgtggaaatggcttgttcataaccatccttagctggcttcaccagattatcatacctggcaacaaatttctctttagtaggctccaatacatccttggtagtgtttcccaactccttgaaatggggcaagtcaacagatttcccactagaagatggatgcgtctcatccttgattaaagacaagggtctcaaaatcaattctttcactgtatagttcaccacattagcagtatagtctactacgaaatatgccacccatacacctaacttcccatggtcatggtattcttcaacgaacgtatcaataccttctctgaacaccaaggtgttgatgaattcgtccaacttcttgacaatggcaactgatctgttgaacgatcttttcacgaacgttggggtctttggagactcgatgactttgatcctgaactggaacaaaattagggaaatggtagaaattatatttgacaccaaagacaagctcaacaaggcattaagccactttatcaacgtcggatacttgttcaaatgattgatagtagcatactgtgtagcaaatttatcagtagatggtttatcaacaacaagtctaactgaagaagaggagcgggacctttgctttttaactgggcctgtcatttttaaaggatctttgtactgtatttggttctaatggataaaaacgatagatttccctggtttacaacaactgcacaactctatttcgcctttaaaagtactttgcagttctacaaacttaataaactgatataaatatatatttatatgtaataggttcgtatccctttgaaactcaaagcaatgccttttatttatagtcagtctctaaaacattatcacaagttttccttaatttgaattcaatgcagaaaaagaggcagagatagaaaccaaaacgaaactgaaggatacagtgggctaacgtagttggtgtttcaactgcgattaacattgccatgttaatccggaaggaatatgtagatcagatatgtttctagatccacggattatttcgtgccttgccagtagtcttgtcaccattccttgctattacccaaaaagtaagcaataaacagacttgctccctatgtactttcattcgtaatctgctcgtagttctttttgctatacacttttgctgtctttagggctcttagttgtgccttttcagcccatttttcttactggtaacggggccttcaggggttcagaccgttagaccgttacttccgtttgactttgacaccacatgatgtgcatgtccagaccttatggccatatatttccacctgcttaaaataagaacaggtggaaaaccgcgcacaaattgtatgcatgccaggcaccgtccgtatctggaacatgcgttgagtagattgatgcaaggccacagcttagggtgatgtttagatagagagtaaatacttttgataaccactgcttactatatatcggtggatgtgaaaaaaaaaatctctttcaggattgctcgcattctggaggttggactttcttcagagcatctttattagcgaagtcgtcctcttcttcctcttcttcaccgtcctgatcgtcaaattcatcgtcgtcttcttcttgttcatcgccgtattctaattctagtgctgcaccggtgaaccaatccactgcccttggaatcaacttgtccttgatctcttcaccgatagcataatctacagccaatctactctcaagttcagcgatttcttcttcgtcaagatcgtcttcttcttcgggatccagagactttggtgggtcaaagaagttgaagaacgattccactggtgtcagcttttcaatggtacgaatttgtttagtagtcttgttcttttgttttcgtcttttcacttcgactgtaacgttatggtcattatcgacccagttaatggtttcaccctctgcatggtcatagatgaagtcgccagagtaacccaattcggactggtagtagtatgtctttgttaaagtttcgttagtgaagaattcgttctctttatcgaaggtgaaaatcaattggaagcctggtttaccctcagttagatactctagagtgatgttcgtcaagtatgtcaatacatcacagtcagcttctgtcacgttttgagaaaccattggtaagttctccatggctgtcaaccagaaacaagggacaccaacgatctcttcctcaccttcctccggttcctggtcatgctcttcttcttcatgctcatcttcaccatccaaagatcccccgcgtttgatttcttcttcagtggcttccttatcacctgtgatcaactcgtaacggtgttcgtgtaatggtttgtatttctgcagatatttttgttcaagttccaacatttcaagctggaaattcttctccaattcgaacaaatcggactgaatagcctttaaggctaagatcctattgttcacagcttttgggagtctttcgaaagcttcttcatcgccttcttcctcttcctcttcttcttcttcttcaccctcatcttcttcgtctatgttcaagaactccaacttttcattgatccgggataaagatggactctcgttgtattcgctatcgtcatcctgatcttgatcctggtcagactgctgctgttgcttcttccttaaatatgaatccttaagcacgctagctggtgtgttatgaggcgttggtgcattatcgatcttactcgacctcgatgtcttgatagggttggacatttttatgatgtgatccttactattttgccaaatacactcaaatgtatacagctaatgtagttcaaatatcctgctgcaacactccaagtatcacaaatagcccactacctctacgatcagatgttccaagctgttacgtttcctactgaaagaaaattttctggctaaaaaatgctcttcttatatattccttacatattaaaatagatcacggaagcatgcaaatactgcaaccgtatgccaattcaaaggactaaatcgtaccaattcctggtaaaaaaactcggaataaagcactcctgatatcaacggtacattatataatgaatcttgagctgtaaaatactctgaagtaatcctgatcccctcttctttctctcaatagtcgctttctttggatatcagaatttcagttttataaagaatgcaataaaattagaaaaagcagcagggaattcttttcaaacaagaaccaactacccaattaacggtctgctctgctcattatagaatacgatttaccattacctgttcgagtttaaggtcagcagtttacaaaactataataagtttcaattttaacatggttcgtgctattattgccccatctattctagccagtgatttcactaaattaggttgtgaatgtcacaatgtgattaactctggtgccgattggttacacatcgatattatggatggtcacttcgttcctaatatgtcattgggacaaccggttgtcgaatcgctacgtaaagttatcggaaagtacaacgatccagacaccaagttaccaagagcattcttcgattgtcatatgatggttagtgaacctgaaagatgggtcgaagattttgctaggatcggttgcgatcagttcacattccattacgaggctacaaaggacccggtagcgttggttaagctaattaagaagcatggtatgaaggctgcctgttctgtgaagccaggtacccctgtggatgtgttgtacgagttggcaccatccctggatatggctcttgtaatgactgtcgaaccgggtttcggtggccaaaaattcatggccgatatgatgagcaaagtgaaggacttgagaactagatttcctaatttgaacattcaagtcgatggtggtcttggtaaacagaatgtcgaacttgctgccgaggcaggtgccaatgtcattgttgccggtacctctgtgttccgcgcgcacgacccagcagatgtcattggatttatgaaaaccaaggtcaatgatgcattagtgaccaaaggtttatacgaaaagtagtaagtacctaagtacatatacgcactcttttttatgtcagaataatatttaatgaacgatccgtttaagatctatcctagtatacaaaatgtttatatagacaatgcaaaccccatttaacgatttttaagactctctacaagaaatactgaccacctagagttgtaccagaacctgtctgaagggataaaccttgagattgaatatcttccaacaccgtggaaatagcctctctcatcttttccaattgtcctttcttggtttccttctccttcttcacaacaggcgcatcaatctgcataccaccgttttcctcactttgagattgtagatcaactaatagttttctttgttccacgtatttcaagttacgttcgatcttctttgctcttttcttcgaaagagtcttggtcgtaagagcaccagaggtcgaatgctcgcctttgtaaagatccaatggtatactcttcaactgaccagatttagatgttcctgaagatcttgctggtgccaataaacccttcttttccatagcatctctcttggcagcacgttgatgaaccttacggttcaagttaaccttttgctttggcctgttaatggagttcttagatggcatctcgaattttagtactgtgattaaccgttaacttgtagttccaggaatactagccagtactaagagtaacaagtaacaagatagctagcacaggtgaatagtaacgggggatcaagtacatggtatggagatgcattaacttttcaacagattcgcgatgagatgagatgaaaaattttagaaaagaaacggcagtacaaaatagatacggtattagttaatgaaaaatgctaagatttaagccaagacatgccgacattggtactggagagcaccatctatggaaggggtaagaataggtggtgataaaggccacggtgctcattacatttcggctaactgctcactttatgtataccagcgttatttcatggtaatgaaagtgacatagttacccggatatttaaatacgacccacccttagaatggaccaatacatgaaaaaaacacacggtagttggaaccatgacaatagagaaaggatagaaactatatacttgtgttcacaaggattaggaggctagtttaagttcaaccgttggagttttgtcttgcctttcagcgataattttctagtttgaatatatcgattcttgattgaacaattcgtatcaatattcaagttttatcgacagtaaagacttaaaaagaaaacaccaaatgactagtgatgccgatgatgtgctagagtttttagactctttaccagccagtactgctaataacactaagggaaagggtaaggttagtgggaacggcggccaggatgaggatattatggaattcttagacgaattggaaaatagtaacctggatattaagaagaaaccgtccaaaaaggacaagccacaatcctctaagaagcaagagaaagagaaaccggaggagaagccagaatcgaacgagaaacctgtagaagagacagccagtaaagagaaaccgagtgaacagaaaggaaaagaagaacatgtggcagaagaaggtgaagaggcagttcaggacccactggcgtcaatttccaattggtggtcatctagcggttctgctacagtatccagtttctggaacaagaccacagaacaagccaatcaattgaaagagaagatagctactcaagagggcaacttgaaaataaacgacataggggccagattaacggcattgcaggggtctcatgtcatttctgggcttacttcacaattgactaagattgtcattggtgaaacggatgaagtgatcagaattcatttggttcatgatttacacaatttgaacgaggaaacgattacgtatcaggtggaagaccaattcgaaagattactatcgcaacaggtgcaaggtggaataagaatatttgctgatgaatgggatcacggcaggaaagtggatgataacgttaacttgaaccttttccaaggtaaagccgttgacggtgaaaaattatgcttggccaaccttgacaatgcaatcaagacgtgggagactgctaagaaacaatcgagaagaaccagtaacccagtgagtaaagtaagcgatctttttgtcagcattctggcctgcgaggttactgggaaagacggatcatccgaagccgattctaacactgttttgatcgacgcatcgagacaaaacaacttccatttcattgtcatcttgaaagacataagtaatgatatcttgctaatagtgagatcccaaggttacccctccaaatgggccaaatggttacaatccgatgcactaagcgatgaggaatccacagaaaaaatcgacccaagtgattgggtgaaaccatggatatccgaaggtcttgatctaactttcggtattcttgcccaacaatacgtcataagcagaatgaatttgtgaagtgtcttttacatacatattttaaaaccctaattactgttattaatcatcattattatactcccatatcagttttttggtaaccatttctctttcaacgattgaaccgtcgtgcctaatacagctttttcccagtcaacccataagctcgtctgtttattccaagacccattctcgacacatttctgcaatggtgacccaaatagtggatcctcagcagcttttttcaaaagagattccgtcttaggaatctgttccattaagtcgggcttatcaatttttgccaaatattccaattgatctctagtagggaatttctggcatatttcaatgttgattttgttcttgtggttcgattttaatgccgttagaagattttgagcatgagatgattctaatttgtgtgtgaataatgtcactacgcgaggttgaaattggatggttttaaacatagacatgatgaattgaagatactgattgtcaatgtccccctctataaaaaattcgaacttttactcagttaaatacttcagtctaattaagtcaggtcaccccagtaattgttgctgcctttatatacgcaatactaaattaagacatctttgaaatatgtacattttggaaatcatactattatccctcaaatacgcatggcagggaaacaaaatcccggaaaatccagcaatcaatactatgatacggagtcatgacgtccctacttagtatccggattggcagcacctttcacctacttggaaacagaatcatcaagctaaccatttgtgccttgtctgtgcaatgactatgcggtcctgtagcaaaggtagtcatcctatagttaccctgcctcaacgttaccatacattttttttcttcaattcgtttcagctagctcaacatcaaatggaattgcaatgaactgccaaaaagatgaatcgttggacgctttaacggcctatttatccttcaagtgatacccagaactatcacaatcagtgttgaattttacaattcattataatcttttttttttttttcacttgctcattgaaagaatcagagtctcaaattacaaatgtcctcttcgtctccgaatagcgacagagcaagttcagtaggagttactgaaccagtggcttccgatgtggaagaaaatcgtcctaagtccaagctatcagaaggtgaagcagatttatatttggaccaatacaatttcacaactacagctgccattgttggctcagtagaccgcaagatattcgtactattgcgcgatggccgtatgttcttcggtgtactaaggacgtttgatcaatatgccaacttaatactacagcatacggtggaaagaatatatatcgagggtgagaataaatatggtgaatgtgacagaggagttttcatgataagaggtgaaaacgttgttatgttgggcgaagtagacatcgataaggaggatgcaccattggaatcgatggaacgtgttccatttgaggaagctgaaagctataaggagaaaatggacgaggtgaaatacaaggagaacactgctaagggtaagagactagcgcagcttggtttaactaccgatttcaataaaggtgatttgtattaagtataagattataattagtttaaaagacaagcaaaaaaaaatcgtaaaacatacaattcgaaactaaactaaactaaactaaatcattacacaaactggagatcgtgtggttttgaagggtatttatcttttgatactcaattatatatcacatagagatatatatattcacttatatatggttcggtactgtactattcataataagtaaaatgcatagatagcgcggcatggcattccaaaaaaaaaaaaaaaaaaattaatgggacaataatccccatttgacataaaatagaaccattataacggtcaaaattaattcttaactaacggatcaactcatttgccagcgagcgtcgttaattcttgatcgtatgtcttttgaaatttgttataattactgatttccaacctccccagttgtgatattaatgattcgtccggcgtatcattaattcttagcgatcgactcacttgccacatatgtgacaagggtgtttgtgttgaacagagtccgtaacatccatgcaactggatagaccaatccaccagtgacgagatttcctttggtgtcacggctttcaccatcccaatttcttctcttgccgcttttacaccttcgtaatcacatttgattgccgcgttgaaacaaagcagcttacaggtttcaatcttaatcctccaatgagcaagatcaaatttgaaatactcactcttctgtaatttggaaccaaacactttcctttcagcagctctcttattggaaagtctcaaggattcttgtcccataccacaaagttttaagcattgaaataattttgtaacagaggatttcatttgtaaaatttgataaccttcacctctttcaccaataatatttaacggtactttacaatctttaaattgtacttcataaaatttaccaatcgcttcatttgtttctataggttcaattcttgttgaatttggtggtaaatcattcctgttaacaaggcataatgtatgttttctataaatgttgccctcatcaaattcagtgacacataaaactaaccaaatatctgagtctcctgcatctttgataaaccatttagtaccgttaagtgtcatagtagcctcctcttcgtttagatcatccccttcaattttacaggtggtttgaacgttcaacgcatcagaaccagacacatctctttcacttaccatcaaacacgatttcatattattagaaactaactcatctatcacttgtacccacaaatcatggttcgaacaaccatttctcaacaaaacttgtatagttcctaaatcgatcaaatcatccaaatggaacaaataactggcaatgacagatcttccagcaaggaaagcgatcatagcaaattcaaccatactcaccacttcccaattatcgttgaaactatggtcgtacccacgttgatccattggaacaaacattttatgcaactggtatgcctccaatttcttccttaaattaataatgactgggcacgtctctaaatcgctttcatgctcaaatagggtactctcttgcaaatacaccgtatctaatggcaaacattcaaactcaacaaatttccgcaacttcttgaaccgatccatctgcctctcatcaaatttatccctaacactggcaggtatatagtttgtgatgggatcaacatcttctaaagcaggtttcttatatgtccgcggtctatcactgacattaggcatctctcctgtttttaaactcaaaccgaaataaacgtcccactaatctaaactatctaaatatatcaatagataggtaacttgtgttgctcttaaccgcccagtatctaatataaaatatgttaaactgtcttgacaatacagtggatgtcactaattattataaagggaaactgagaaagagtttacgattttcgtctgctatttatttgtcaacgacagaaaataagatgatgaggaaatcacataataagaggaagaaaagacacaagaaccacagacttcactgtcggctgacactgacacaaaaacatactatctaaatttgaaggctagaactccctaattctatgtatgcttgtatgtgctttgaaattgaaattaatagcaattagtttttagtatggtatctgaagcgatcaatatctacctatctatcccccatttcaaagattcggtgtcactatctcagtcacaacggtagaactcacattcactaaggtctgtaaaacgggcctagttcatttgatggaatagagcgttaatagtgagccattacacactatcagcaagatgtcacggcacaaagggtaagtaacgttgtgcgttggttgttgagagagggaaggggtgtatatgtgacaaatcattcgtttgtagcattacttaaggttgttcagtagactcgttatattggtgtatagaaatcggaaccaaatgtcactaacaaatcagaaaagtaactaattgctgctgacttccgatagaaaaagacgttttaaagtttctttctttcacgataactgttgctcccctaatcaggttagcctgttaatccattctattccgaagtttgcacacttgaaagacgtctctatctacggtatgtaaggtatgtttacataatccagtaacgcagaggaaacggatcactccttggctgtggtgcagtagcaataacgatctatgcagatttctgggtcatccagaactttggctcccctttcgtagttgtctatagtatctgtttgcgatgaatgtttcacggtatttctctgatatctgtttgtctacaatgaaaattcctatttgctggcatttgtttgcttttgtcgcgcgacaggctgccatttacaataaacagatatacatacatgacagctaccaggtaccgtgaacggtgttttcagggctttagaatgagatcatagtatttatgacggttagtgttattgattgtatgtcgtgcatattctatgagggcatttctggtgatgattttctttgcttctaagggaccggacatattatggttttttttttttggaaatgtgtcacagtacatcgcatcgacgttgccttgtgaagtttccaacagatgcagattgggataagcgtttctcactgttggaagcaattgaaatgtataaacttacgtcccctaaaattttaggtattagacctgatttaacaactcaagggtttgtttcaaaggatgttcggtcaatgtcacacacataccactttatagagttgaatgatcaagcatcagatgaaaaaactgcaggttgcaagagcaagaacatagaagtatccaggtaatgagttataccgagtatagcatgtacactgatgacagtagcagtgatgaagaagatcagataaacgtagttgaaagtgaagctacttctttagaagatgatgctttcgacgtagacagctttttcatggaagctaaacattcgttatcaatccctagtgttgaaaacgaatctcgatgctttgaagcagatgaaggtaatagaagagcatctttgttttctgttacaactggaagaaatggaattgaagtgatcgaagaatcggaatcagcacctgatatttcaacagtgccatttcaagagtttgcagttcgttacgtcaataagtatttggtgacggatttgctttataagaaaagcattccaacttgggatcattcttgtcacgtcaacgagatgaaagctttaccggaacagattagagccatgttaaaagtgaaaaatctcaaacttgggcccttgatgaggttgttggtgatcaagtcaatacatgagaggatcgaatactatcgtgacagacttccaatcgatattttaacagaagaaaaagatgagatattagctggtcttatggccagggatttcaatgacgatgaaatttggaccaacactttaaaatgtatcttggaggcaggttttgtagcaaagacagagatttccccatacaaccctaaccgcatgtcgtttgaagagaaactagatacgctgaaagatgaaaatttggtgcaagagggtgacgcttccgatggtacattcatctgtcccagaataaccttcaacatttcaaatatgaaaaggcataatggctattacagagcttccaatataaagaggcacaaaatcgacgagctattagtatttgatccaatggtaaaacaaagaatgaatgccaaattacggtcttacaatagtaggaatgggggccaaatacctaaatttactaaactggagtttgagcagaatatcaacttaaatcatcctttgattccccatctacgaaatttgagaaacccaagacatagaaaacacatcgctggcgagcagaatgcatgtctcctattcaatatagaccaataccaaacattagaagaggagtggatagactctaagaaaaatcttccgattacgggtattggcggaaaatctgaatattcccatttccatgctccaacttcacactcaagattcaggcgactttcttccataactggatcctactatttgggatatgatcaaaagctattttgtcatgatagttatcggcaatgggttttcaagagcgttcatttcaagagaattgctgcttacatgtatgcccaagaactttcaactcagaagaagataaaagaagagaaaaactggccatgcattgtatatgacttgaacattcttaatttacctttcaaagccgcggggaaggacttcatacagacctggttatgtacaccgcaagatgaaaccgatgaaggcttcgtataccttcctggtttgaaagaacagtaccaggctatggtcattgaaaaactgtcacaagaagaataccttcggatacagtctctaaagcgggatttaggagaaccggaagatgatgttcctcacaaaatagtattgaactttgacttctgattcttttcaaaagctccagtacagccgcttctactcaagcagtagttagcaatctcctccatatatataccgtggaagtgtattatttaatcctataccactttataatcacatgaccttgtttttttttttcattcaagctttgatttcttttactgttctgtcaagattgaagtagacttcggtttaagaaaattttgagctcatcgcatctcatcgcatagtttacagtgctagcagcattaagcttggaatgccagtaaaactaccacaattacaacatactatcttgcaatcgtgcagaatcaatgtcacaattttttgaatataaagacactataaaagagggtgatttggtgcttgcatggttgtccagggacaatttgaagccaatcaccgtgaaagctggcgaggttttcaacactcgttatggtgctttctcacattcagatatgattggaaaaccatttggttctcaaattgctattagaacgaagggaagtaatagatttggtttcattcacgttctgcagccgaccccggaactatggtctatctctttacctcacagaacccagattgtttatacaccagattcctcctatatcatgcagcggatggagtgcaatcctagatctagggtcattgaagcaggtacggggtcaggttccttttctcatgcgtttgccagatctgcaggtcatttattctcatatgagttccacgaagtaagatacgaacaagcgaagcaggaatttaaagaacatggactattggaagctggaaacactaccataacgcatagagatgtttgtaaagatggatttgaaattaaaaacggtgacaccacatcgcatgaattcagaggtccagaggaaacgaaggtggagttgaatgctgactgcatatttttagatcttccagcaccatgggatgccatacccaatttgacttccgttatctcaaaggaaaagaaggtaaatctctgctgcttctccccatgcatcgaacaagtggataagaccttagaagcgctagaagaggaaggatggcaagacgttcaaacggttgaaattcaagggagacaatatgaggcaagaagacaaatggttcgtaggttggacgatgctatagagaggttaagagacgtcaagagaagaaaacatgaaggcgtggagaaacgtcagaaaaatgtcgaacaaacgagcaataacggttcgtctgttgaagccacagagtcggataaggacctgaagcacacagaaaagacccatttcaatccatttggtaaagggtctcgtgtaaaggaaggtgattcaaacttcgaatggactcaagtttctaaagttgaattggagatcaaatctcacacatcatttttgacttttgcttcaaaaatcatagacagaacgagagatgaagaacaaacaaaggcatacctagcgaccttcaaagacgagggcagtaaattgagcaaaagggaacaacgtaggctgaaagctcaagcgaataaagatatccaaaaggaataatccgaagtatataagcacacatatatagatatgtatgaactctctgtatcaatcagacaaagtctccaaagatatctctcctacgctgggcccacaacggcatatctcttctaatcttatcttgtgcttcaatatcgagatcagcgattatgagctggggatcatgcgtggttagatctgcagcagacaaaatcctaccccacggatcaataatcatagaatgaccccaagagattctttttactgctgattcatcagatggtttctcatcagcatagacatcatgttcaccttgttgagctggcataaccacaaaactttgagtatcaatcgctcttgctctacccaacagctcccaatgggcttcgcctgtcttcatagtgaaagcactggggaagcatagaatttgcgcccctttagagcgtaatttcaaagaaagttcagggaaccttatatcgtaacagatacaacttcctaattttcctactggagtattaattatgcttggaatttcggaaccaggctgaacgctgttagattccttcaaaatcggaccattagggacatcaacatcgaagagatgcaatttttgatacttctgtagaatttcaccgtttgaattgatgtatagaagaacattcttaactctggaatccccatttttggtatttacttcagaaggaggcatatgaataccaatggaaatatcaattggctttcctgctgccttcgtcaattgacatattgcactttgtagttcagaaataaattctggcgtttgtgaagccaattttttagaatgttctgcgtttctgcttaagtagtcagttgcttctggaaagaataggactttaacgtcttgatccaaagcttttttaatcaatgatttcacaacttctagattctgcttcaaatttgaggaggagcacagctgaccaataccaattcttgctacgttcataatggaagaggatctgataggtgctcgcggctgatttctttattggacctacctttaagatagagtatttttaatgttatctcgtattttggtatctagtataatctaaaatcgattgcatatacacaacccttaaaaagatacgaccgtttctgacagataaagacagcaagacctgagtctgctaacggaatacatatcaaatgtgtgctcttaaccctttatatctgcaagtggaaataactggcacatcatttgtttggtattcttagggtcacgtgaattagtaggattatcaacacttcaagtattcgtaatggtaaacgctattcataaactaacgaaataatgattattttggcgtcttcccatcagaaataacagttaacaacctctattcatcataaaactaaacagattaagtgccacaaatgtacggcaatgaggataattcacagatgatggatgatccgtactcgacacctttgcaaccccaaacaatattgttgcgcgatggggaaacagtatccacgatgtatccgatccctgcaaacccagaccttcttcctatagggcttgtagaatttctactcgatgagttcaacatggaaattgagaatggacaaagcttcccatattatgagcctctatcacttgatgaatttaaaaagagctggtttgactgtcatggtgtgttatgtgtcatggttctcggtgaacttccggagttagattactcagtaccaattaaccgctctgaagaaatagatgaagtattaggcctgaaatatagtgaaaggtttacgtcaacttatatgaaaagaaaggaacgtcgtaatttgaacctcagcattcaatgggagagacagtgtcttggaatttttgatttaaaacctgcatatccaggccgttcttctcatgtcgccactggcacattcctggtaaatgcaggtattagagggaaaggtattggcaaaactttagtggattgttttctgaactgggctcctcagcttgggtttacatcgtgttactttccgttggtatacggtactaatgtaggaatacgaagaatatttgagtcatctaactttaggagaattggaaaacttccagaatcaggtattttgaaaggatttgactctccagtagactcattcatatatggtaaagagtttactcatgttagtaaacacatgaactctttacattcatcagtggacgacactataaaagcaaaatacgaaagactcatatattatctagagcacggagaataccccccatcatgtaatagaaatgagaaggcaagattacgggtaattgctaagaagcattcccttattaacggaaagctccatttcaaaggaaaggaagttgtgtatgatccacaacgacagttgagaattgcatatgaaactcacatggttgaccatcagggaattaatagagtaacttcaaagctagccgagaaataccattggaaaggtattaaacaaacagtaatacaagttatcaactcatgttcgaactgccaagaaaacacaaataggatgtctgatgaaagcgttgttattgacacaagaaccgatcccaatggccaaccgcacacaattgttcatgcagttccacaaggtcatatatctgaaagtttggagacattagaagaattgacaccggcggactccaccaataaatctcggttgaaaacatcatttgttcaaaggattaaatttggcaaagatccgggctctgagagtgtcaaaagaaagctggtcacgagctcagatgactcgatgaattctttttctaactatgctaatgaaggtatcaagagcagcagtaggaagaagtcgagaagtggtgatccaagaggcagcgaaccagggactgtcatattggaagaagagacaccaaatagcatggtggatgacgcgttactaaacctagaagataacgtgatggccgcagtagaggcagttcggaatgagcagcaacaaaaatcaagtccaggtagtgataatatcaacgggaacagtaaggatcctcctcatggtggcccaaaaaatcatggaactcgtatttcctcggaaggaatcaacagacaggcctattattaatgtccaatagacaatgtatgtaactatattcaaattatttatagatctctcttaacgacgtcgaaaacaacggaattgtcactaactataacatctctcttataatgttcctttattgggaattcgctgacaactctcacattatgaacagaatcaccgctaccatggttcccggacggtgagagagtgaattcggatgatccaatttgcgatccctgaagggcattgataaccatatgcggagttgaatcatgctttctgagatagttgaaaatatcctcactgttatcaattacaaattcttctccactggtataatctttgatgtactttaatctatcgacagttctcccaacagttgccttgtaagaaagctcagacttggaaacgtcaatatctaacattctcacgctaccaaccaagttccaagaagctttgtcgaccagtgaaataataggatctgccacaccataggaggcattctcgtaaagagaaatgatattgtacttctcgaggttaactacagtatgttcatcattaccgtcatcgtagaatgtaaggttagatacaaattcattatgataggtatgtgaaagcacataaggtttgtcttctaaataaagaagactcgccacttcatttttggttgtagcgttaacggcttggtgtagatggcttggatttctgtcaacgacattaatatcaaacgtagagtcaaatatgttggatttcaattccttgtggttgatacttgaagcagggttagtccattgtttgatgttaccagaaatgatccagttctcgcctatagtgctcttatatttatcgtccaaactggatacaatttccatttgtaattcccaaggtttaccatccttcaagagtgggataaaaggtgtaagatcgacgaatagactttcaaggtcaaaggcatcgataccaacacaaggtctccaaagagcaggcgagaacccaccggtgtaaatgacaggagtaggaattaccgttgaaactaaatagtcatgttcaccatcatataagaagactttcaaagcacgtaggggaccgtgacccatgacttctcgcaagccatttttgaacttggatacatatttgtccaacacattaccgtaccagaactcttcagctgcgttacctgagatgaaaacttccaagatggcatgctctaagtcatcttcatgggccgcgaaatcttcaagagaacgtctccaacgtggattggaatgagaggaaattggatagtacaacaatggcgttcttctcttcttatcaccgaccaaaggaagaaccctgcttggtggagctgcggcataatgatagaagaaatcggtagcggtttcatctgtcccatgcttcgcagtatgttcataatagtagtgaagcttcaattccacgttgaagacaccagtttgtttgtttgtgacaatgttgtccaattggaaaataagttccagagggtcatcgctatcttggaacaatgagatatattgagttatatctttcgatgactcactgacaatggtagcctcatcataaggttccacggtagaagtcctccaaacagtaacgttgttgataaaaatgtgacctaaacgatcgtgctgtatcccagtaatatttgtcgagagttccaagatgatcttattataaggggaaccagtgtatggcttaaacgacgcctgagctggatgaccccaagaatcgccaaacgagtaggataagaggtgttcagtatggactggatcatgaagcggtaattgtttaatcgttatttcaaatgacgtttcaacgtctggatgaacgtccagctggtgatgattacaagagaagttaccaaagaataaccctttatgataaccgaataaaagaagggaaagagccaaaaagaaatggaaaaacttgacaaatctagtcttcttcctcttaccgtcgttcccactctcattcttttctacatcgtacttccagtaccctgtgtccttttcagcatcaatcgattctatgtaagcaggaggttcccctgcatcagtagactttggttttttatcctcgcaaaccatttggttccatatattcatctcattccccttagtacccatatctaccaacacttcaattgcttgtcctgggtgctacaaggtgcgtctcttccctgtctcccctctgcaatatacatggataatttactttcatggctatataagttctataataataataatattaaatggaaaatgtcaatattggatatgcacacaatatttcacagatgatgaagaaaggaaggatcggacagaaaagacaagaggggacaatcacagcccgaaggcaatagcaaagattgaagatggtgctagggttctttacgcaacttcggaacatattcacgcaatactactcatcatggcagcagattgtactttctcgaagagctttcttccaattgctagggtacttgggaacatgcgctattttcacaatgctcgcacaagcgcaatgaggggtcgaatgtcacacgacgacaaattggctttaagacggtgcacaaaatgctgtggttcgtagaacattgtccattgagctacaccgtcctccctccacatacaaatcccaaagagaatagtgaagagagcttggaaaaaactaacgaacgtccacgtgatagtcacgtggacaccatcatccccccgggtaacattcccgaaaaaaagatttgcatatttgcaccgcatacatgcaccacacaaggttagtaccgggcaatggcctgattcccaccactacccctctctctgcatcaacaactacgaaataaatgctcaaaccatattcacgatcttgcttttcggtctacttcacgtcatagcaggctacaccgaccaacagacacaacaaaaaccagaaagtctaataatcttgttaaacttgcaggggaattgtagatttcacatacatactcaagtgataaatgaagagagggtatttaagtaatgtacaatataatttatgcaatgtatttacaaagcctcgtgtagcaatagcaactgcgggaagaacccttgcttagctgtgacacggatcctggatagtactacaattccttcgttttacttctactgctaggcgcatcttactgggaactaattttttctgtattttttcttatctcctttcttgacaaatttgatttttgatcgatataattataacgattataattcaaactcaaaatcaaattgaaattaacctttcagtttgatttagtattttgtctggaaaacactctttgacaggaagagaaaaggagtgagtgaagggtactttagtaaggtgagtagggcgattaagtgtgtccaattatgagtaatagtttgagacggtccagtgcgtcatcttcttcgtcgcaggggaaaccaggacgaaatggcagtgggaatggatcgtattctcaaatcaattccagtttgcatgccagagtgaaagctttccaagaacagagacagttgaaacggtccggtagtattcattctaaccagtcacagaattcggttcagatagagcagattgtgaataaaccgttgccgcctctgccaccgaagacaatggttgaagaggctgagaatagccagcaattagaacaacaacaacaacaacaacataatatacaaatacagcaaacacaacagcaacaacaacgacaaccgatcctaaaacaacaggaccagcatctacagcatctacagcatacggaattgttagcacaatcagttacggaaaatgaccagcatgatcagcagcaacagcagcaggggggcctgctgctgtctcctaagacagaacttcccgatatagaggaaaagaagggacagtttgagaagcagacacaagaggctctggcgaatttgagtatacagtctgacggtatgtcatctgcttcggaatcttctggtagtgccagtaataagcaacaacaggatcatgaactcaatccgattagaaaggctccaaaacgtccgcaaggtgttcccagttgtactggcagcggcaatgctggtgcgccaagtccaattggtggcgtgggaggttctcaggcagcagcaggtactttcagaccgcctgctgctgctgggggcgttgtaatgccaaatcaaccaaggctttcacaaggtcagccacatctacaaaaggctaaacagtctttgtctgcaagaagaggcttgaagcttcctacgggcggcatgtccttgaagatgaaaccaacacatcaacaacagcagcttgctcctcaacatacacatcaagaatttgcgggcgctccctccaattctgctttgcccttgcaaggaaaacgttcgaatcccggatctttgattaatggtattcaatccacttctacttctttggctaatagttcacatgatacacttggcactgatcctaaatctaatcctacttctaattctaactctggtatcggtggattgtttgctaatttttccaagtatgtcaatattaaatcaggatctctaaatttcgcaggtaagctgtctttatcctctaaaggtgtagactttagcaacggttccagtttccggataaagttagatgaactagagtttctggaagaattgggtcatggtaactatggtaacgtatccaaagttttacacaagccgactcatatcataatggccatgaaggaagtcagattggaattggacgaatcaaagtttagacagatcttaatggaacttgaagttttgcataattgccagtcaccgtacattgtggatttctacggtgcatttttcattgaaggtgccgtttatatgtgtatggaatatatggatggtggatctctagataaaacttatgatgatgaacaaataggggggattgacgaaccacaactagcaaggataacaagctcagtaatacaaggattgaaggaattgaaagacgtgcataatatcatccatcgtgatgttaaaccaactaatatcttgtgttctgcaagccagggtacaattaaactatgcgattttggtgtgtcaggtaacctcgttgcctctttagccaagacaaatatcggttgtcaatcttacatggccccagaaagaatcaaatcactgaatccggacaaatcaacgtattctgtccaatcagatatctggtctttgggtctatcgatattggaaatggcattgggagcttatccgtatccgccagaaacgtttgacaacatattctcacagttgagtgccatcgtcgacggcccacctcctaaacttccagagggaaagttctcagccgatgctcaaaactttgtttccatgtgtttgcaaaaaatccctgaacgtagacccacttatgccgctctattagaacatccatggttgaaaaaatacgaaaacgttgacgtaagaatgagtgaatacataacgaatagattgaacaaaaaaagggaattgctagaacaaacaggcgaaggtccacctaagcacgttcctgctttgcatatgggcggattgtaagttaagctttgcctcgccttcttatcttccggttattccgtaatatagaagaaaacaaagcgaaccacagtttaaaacccactaatccaaaaatcagccttgctccatttattttccagcgcttgtcataatatttcagaactacaaacctgtttacatgccatttatttagcgcaaaattcattacgtttattccaatgcatcaattactaccgacaatacatttattggactgatattatatactgtgtaatttgtatgaaccgctatcatctttatggtagcatttaatattttgagaaaaataggtcctaccatattctatcaatgattatgattccattaggatcactcaaatgttggtgaaaaattcgtagcgtctttaatgtcaagcgcaccaacgcttttatcgacttgtgtcaggttttcctgtttggccgcatttcgctgagaatgttccttcgaggatttaaagcctctcatgaaaagttatgaaattgatggaaaaaaaaaaaaattgaacatatgccaacctaaaatgatttatttagtaccgaggtttctaaagtataaaagcattgaattcagacaaataaacttttggtaagctactcaagttaccgtcaataataacaattctcagtgttaactactggtaacctgtattagtaattaccaggtaagcggagagatgatcttccgcaaagtggtacgaaatcctactgttcaaaacatacaaatatacagaaagactttaggtcatcagattcgtgacattatcgaaaagttaacaaagaaaatcgatcctttcgtcaaatttatatttccaaacttcattgcattccattacttttacatcattgcatttgcattactatgttctattcttatttatcccgttaagaactttgcatacatcgatattttgtttctagccacgggggccgcaacccagggtggtttaaacacagtagacttaaatgagctgtcattgtaccaacaaattgttctgtatattactaccgcgctaactaccccaattttcattcatagtggcttggcatttgtgcggttttactggtttgaacgatattttgatggtattcgtgattggtccaagagagattttgagatgagaaggaccatgacactgcgccaaagggaactgaccaaaaataatacgatggaaaatgcttctaggagtactggtcaaggtcctctcaattttcttaccagaacttttactcacggagatagagatgctagtaattttcaaggtaggcttttcagaggagaagtggtcaaaagagacgaagacaataacgacgatagctcagtcgatacaaggccaccggaggcccatagcgatcatactgagaaattcatcggtaggcggaaatccagagatatcaatccagctgatatgtacagatcgattgccatgttacagaataggcatgaaagtaatgataacataaagggaccagcgcttgtcatcaaaagcccagcggaacgggaaaaagaaatagaagaacaacgtagattacaaaaagagcgtgaggaacagcaaggtcaatctattcagtttaaagtggaaccgcgcccgacaaagtcaacgaggtcaacttttgaaccctcgggaattaggaaatcatttacccgaagaaagaggcctagcttcttcaaaggttcccaatctgccagaataatacgagacaagttgagaagaagatccaaaggttctgatgtcaacaatgttgatgatgaggaagaagaacaggatgggcatgatgcagatatggaaggatcttctgaagacgatagtgttattgaatcttcagatggacagtcagagtctatatctgctcccaattttgaccatcactcatctgagccaacactacagagtggtggtacagtatctgcaccttcttctttagagagtaatgaaatcgaagaagaagatgaggaactaagcgatttacccactggtgtttcttattatgggctgcattcaggaggcgatcctcgaaataggttaaacagggtcatgagtacaaattatttatcatatgagcctaaaattggaagaaactcaacttttgttggattatcagaatcgcaaaaagttgaattaggaggggttgaatataggtccaccaaggttttatgtctacttttgtcgatatattatctcggttttagtattttagctatgatcatattcgctgcgtggatacaacctatgaacaattataaagaaattgttagatctcaaggtgtttcgccaacatggtgggggttttggactggaatgagtgcatttggtaatcttggattaacattgactccgaactccatgatatcatttcacaagtcaatatacacgttaatttggatgatgtggttcattgttattggtaacactggatttccaatttttctccgtttcgttatttggatacttttcaaactaagtccagatctgtccttgagaaaagatagtctagggtttttattagaccatcctcgtagatgtttcacaatgctatttcctaaagcggctacatggtggctttttctgattctcattggaatgaatgctattgatttgatattattcatcattttggatttgaatacagatgttgtaaaagatctaactgctggattcaaggtacttaacggtttatttcaagctgttagcacaagaaccgcagggtttgccgtgctagatctaagtcaattgcatccatctgtacaggtatcgtacatgttaatgatgtatgtttctgtgatgcccttagctatttcaattagaagaactaatgtctacgaagagcaatcgcttggtgtttacgggaatggagaaaatcaagaagatgatgggtcggaaaagaatacaaaaagtttcattggagcacatttacgtagacaattgtctttcgatctatggtatatgtttttgggtctctttattatctgtatctgcgaaggtgggaagatccaagatccaagcaaacccagtttcaccgtttttcaatgtctcttcgaagttgtaagtgcttatggtaccgttggattgtcccttggataccctggctccaatcaatcgttttcaggacaattcacaactatatcaaaactagtcatcattgcaatgttgataagaggaagacacagaggtttgccctatactttggatcgtgccatcatcttaccaagtgcgaaattgaaggaaaatgatttactccatgagttgactcactctaggagacccacaactttaggattgaatggatctacatctcatgataacagaaccacctctgtcgctgattcgacatcttcgattggtaacaaacatatagaccggttccgtgaccgttcacgttccgtatggcacggtttaacctctgcgtttagtatgggtcatcaaccacggccacatagaaccatgacgtctagatcgttagatgataccattacaacggaccgcatgatgtccacgcaaagtaaccaatcttttaacaatgaatcacaacaacaaacattttcggatggtaacaactatccaatgcacagcatgaactcaaaccaccattatgacaacagatctatgacccccaaccaatatcacgtgtttagagattcctttgatctgagatcgggtattactgagcacaaaggtttggatggtgtacatgcaaataccgtggaagcattcgaccattcgaactataattccaacagtaatagcaacagtaacagcaattcaaacagcaagaatacggaaacttcaagctcaggaccaatcttcaatcacatcaattcctctacctcattgcattcaccacattctacaggttcaatgcaatctctgaatagctcacccagatagcaacgatggtacaaaagaccacattctacaccctaaattaaatatgctattaaatagcatgagttattctatcacctctaatttccagactgactgaagaacagaattgaacactcgtaaaatcatgggtaaaacataataggtagacacattatggactttctagtaatcaaaccttattcattgtgctttctttgtcccagaatgcgcgttactgccgtatagtatgcattgcatcgagatgatctcatcactgttaccctgatatccgatggaaaacggtgacatcaccgtcggaggtattggaagccctaacgagtcattatcaagtcacatcaaacgaacagtggtgtacggattctatgtccataatgtttttctgcatgtctgtaatttttgggaaacatttatcgatttgtctacaaatgtccatcgaaaagaaacaattccatctaaaaaattttccgcggtttgccaaactcatctcatcgcatctagagatcctacagccaaacaaccgagagaaaattttttttcttcacctagccgcccatcaagagtgattttgtatataaggaggggtacgaatcccattgaattgttatatcgttttccttttaatgatacttctgaagatctgtcacaacttttttttacttgtactttcttgaagtattttagtttcggtgtatttactgtactattatactcattattctctcagtatattttagaataatcattttgtttctaaattatcgtattcctttttccattcaccattactatatgttctgttttaaatacttttattacttagtctcttcttgttctcagtagtcagctaaaaaataaacttacagccgcccccctttcctctaagtcccacctttgagagagatagagagagtgttaatagcagagaaagttcgtgtatcagtcgttgaaactattcgttttagtatgttctttttttttgttttctgtttggttttctaagtggctactaagcaatgctttaagcttctattctatgacattttttttctacttcctcttattcatccaagttaaaaatcggattgttagtttgcaatcgcagtcttttcttcaacagcgaacggccagcaaatgcgtttttgcagggtaacaacaatttgacgttataattactgcatgagattcaaacttgcgccttcactcttgtcgaatttacgaggcctaaaactttgcgtagctcgaagatagcctgaaagttacgaaggtaccatagaaaaaagtaaaattggatggatgcacgaaaaagaaacagattgaaatttgattaatagtcacttttaagattgaccaacgaataaatgttggttaaattagagattggaaataatcaatagaagaagctagcgaagttttttgctgaaagtgtttaaacagcgtggaagttcacacgaacatcagggcctgatttactaacagttctaatttcaacaaaaaattacgatctaagattagacattaattttaaaggaataaaaaccacttaattgattaatttcttacctataactaagagaggtaaaattagagtcaattataaacttaaacatcaattgccattcatttagtgcgattcttttcattattacacatagttagaaaggatccaatcgggtaaaaaacctcattgttttattttacttttaagtccccccccgttgctgcttttaaagaagcaaaagaagtgaaaataaatccaataggttagttcatcgtttgaaacaccctttacgcttaagaaaatacaaacttccgttatgtctattatcactcctactgctcctatcacccctccaatggagtctactggtgatcgtatgattaccttggaattaaaggatggaactactttacaaggttactcctttggtgccgaaaccactgcagccggtgaattggttttccaaactggtatggtcggttacccagagtccatcacagatccttcttatgagggtcagattttagttatcactttcccattggttggtaactacggtgtccctgaccgtaaattaatggatgaatacgtggaaggattaccacgttattttgaatccaacagaattcatgttgctggtttagtcattgctcattacaccgaagaatattctcactggttagctcaatcttctttaggtacttggttgaaagagagcaacgttccagctgtctacggtattgatagcagaagcttgaccaaacatttaagagaagctggttccatgttgggtagattcgctctacaaaagcccgggacctctttcgaggatgccaactctgctgaatggatgtcttacttcgaaactccagaatgggttgatccaaatgttgataatttagtggcaaaggtttccctaaaggctcctaagcttttcgttccaaaccacccagacatcgatcttgttcaaggtcctgacggaaaaactttacgaattgttgccgttgatgtgggtatgaagtacaaccaaatccgttgtttcgtcaagcgtggtgttgaattgttggttgttccatgggattacgacttcaccaccgaagaatatgacggtttgttcatctctaatggtcctggtaatccagccattctgcaggaagtgtccgatagattgactaaagttttagatgcgaagaagaccccagtcttcggtatctgtttgggtcatcaattactagctcgtgcttctggtgcctcaactttgaagatgaagttcggtaacagaggtcacaatattccatgtacttcgactgtctctggtagatgttatatcacttctcaaaaccatggtttcgctgtagatgaaactagtttgaccaatggctggaaatcattgttcaccaacgctaacgatggttccaatgaagggatttatcactcagagttgccttacttctccgttcaattccatcctgaatctactccaggtccaagagacactgaattcttgttcgatgtcttcattcaatctgttctagatttcaagcaaactggtgtattgaagcaagttgaattcccaggcggtaacattgaggagaacttggctgctcatcctagagaagatgtcaagaaagttttagtcttgggttccggtgggttatctattggtcaagctggtgagtttgattattctggttctcaagccatcaaggctttaaaagaagaaggtatctacacgatcttaattaaccctaatatcgctaccattcaaacctctaagggtctagctgataaagtgtacttcttgcctgttaccgctgaattcgttaggaaagtaattttacatgaacgcccagatgccatttacgtgacatttggtggtcaaactgctttgtcagtcggtattgaaatgaaagatgaattcgaaactttgggtgtcaaggtcttgggtactccaatcgatactgtcatcaccactgaggatcgtgaactatttgctaatgccatggacgaaattaatgagaaatgtgctaagtctgctgctgctgccactgttgcggaagctctagaggctgtcaaggatatcggattccccgtcattgttcgtgcagcttacgctttaggtggtctaggttccgggtttgcttcgaatgaaaaagaattggtcgacttgtgtaacgttgcctttgcttcttcccctcaagttttggttgaaagatccatgaaaggttggaaagaaatcgagtacgaagttgttcgtgatgctttcgacaattgtatcactgtctgtaatatggaaaactttgatcctctaggtattcacactggtgattccattgtcattgcgccatcccaaaccctatcagacgaggattacaatatgttaagaactaccgcagttaacgtcattagacatctaggtgttgttggtgaatgtaacatccaatatgcattaaatccaacttcaaaagaatactgtatcattgaagtcaatgctcgtctatctcgttcctctgccctagcttcaaaggccactggttacccattagcttataccgcagctaagttgggtttaaacattcctttatacgaagtcaagaactcggtcactcgttctacctgtgcttgtttcgaaccctctttagattactgtgttgttaagatgccaagatgggacttgaagaagttcactcgtgtctcaactctgctttcttcctcaatgaaatctgttggtgaggtcatgagcatcggtagaactttcgaagaggcgattcaaaaagctatcagatctactgaatactctaatattggtttcagtgaaactgatgatgaacttgatatcgactatgagttaagtaatccttctgatatgagaatttttgccattgctaatgcatttgctaaatttggttattctatcgatcaagtttgggagaaaaccaatattgataaatggttcttgaacaaactatatagcttgatcaaattttcagacaagatcagttcttatgggtccaaggagaacctaccagcgttggttttgaagcaagccaagcaattaggtttcgaagacagacaaattgctaaatttttgaattcgaatgaagttgctattcgtcgtctaagaaaagaatacggcattattccatttgtaaagcaaattgatactgttgctgcggaattcccagcacacacaaactatttgtatctaacatacaatgcagctgctcacgatttggacttcaatgaccacggtgttatggttttgggttcgggtgtttaccgtattggttcttctgttgagttcgattggtgtgctgttaccgctgttagaactttgcgtaaaaataacttcaaaacaatcatggttaattacaaccctgaaacagtttctaccgattatgatgaggctgacagactttacttcgaaactattaacttagaaagaattatggatatttacgaattggaaagctctgctggtgttgttgtttctatgggtggtcaaacttccaacaatattgccatgtctttacaccgtgaaaatgttaagatcctaggtacttctccagagatgatcgattctgctgaaaaccgttataagttctcacgtatgttggatcaaatcgatgttgaccaacctgcttggaaagaattgacttccatggatgaggccgaggattttgctgaaaaagtaagctatcctgttttagtcagaccttcctacgtcttatcaggtgccgcaatgaatacagtctattctaaggatgacttggaatcttatttgaaccaggccgtggaagtttctcgtgaatatccagttgttatcaccaaatatattgaaaatgctaaggaaatcgaaatggacgcagttgccttagacggtgaattgattatgcatgtcgtttctgagcatgttgaaaacgcaggtgttcactctggtgacgctacactaattgttcctcctcaagatttagaccctgaaacagttcgtagaatcgttgaagccactgccaaaatcggtagagcattgcagattactggtccatataacattcaatttattgctaagaacaacgaaattaaggttattgaatgtaacgttagagcatctcgttcgttcccattcatctcgaaagttgttggtgttaacttgattgaaatggccactaaggccattatgggcattcctgtaaccccttacccagtggagaaacttcctgatgactacgtagcaatcaaagttcctcaattctctttcccacgtttggctggtgcagatccagttctcggagttgaaatggcctcaactggtgaagttgctgctttcggccattctaaatatgaagcttacttgaagtccttgttggcaactggcttcaaattaccaaagaaaaacattctattatccatcggttcatacaaggaaaaacaagaattgctaccaggagtgaagaagttatacaatatgggttacaagttgtttgccactgccggtaccgcagatttcatttctgaacatggaattccagttcaatacttggaagtattgaacgaagaagacgatgaaaagtccgaatattctttgacacaacatctagccaacaacaagattgatttgtatatcaacctaccatctgctaataggttccgtcgtcctgcatcttatgtttcgaagggttatagaactcgtcgtatggctgttgatttttctgttccattagtaacaaacgtcaaatgtgccaaacttttgattgaagccctatccagaaatatgtcactagatgtttccgaacgtgatgcccaaacttctcacagaactgtgaccatccctggtttgataaacatctctgcttatgttccaaatatctctaacgttttgttaggtccagcagagctcaaggaagtaacccgtctttctgttgaatctggtttcacttactcacagattatgccaaagtcttctagtggaccagttattacggatgctgcttctttgaaggttgccaactcagttgttaaagactctgcttacacaaactttggtttcactgttgcggctactccaaacaatattgacaccgtctccgctgttgctaacgaggctacctctttgttcttgccatatcgcgagctttcaaacaacgttccagccgtttctgagcacctaaaacattggccactagataaaccagtgattgctgaagccaagacatctgacttagcttcggtgattttgttagcctctttgcagaacagatctattcatattactgctgtttccaacaaagaagatttgtccttggttatggctgttaaggagaaacaatccaacgttacctgtgatgtcaatattcattccttgttcgtttctcaggatgactatccagaagctaaattcctcccaaccaaagaagaccaagaattcttctggtccaacttggaatcaattgatgctttctctatcggttcattaccaactgctcttgctgcggttactggtaacgaaattgttactggtctcggtattaaggaagctctaccattgttattgtctgctgttaatgatggaaggttgaccattgatgatatcgttgaacgtttgcatatcaatccagctaagattttcagcattcctgagcaaaactccgctgttgaagttgatttggacttcacgttcagacataccaaaagatggtctccttatcaaaaagggggattgactggtggtattcaacgtgtgttgatcaatgaagagacaattgttttatctggtgacttagtcgctactgaagccaagggccaaccaatcctaccatccaagtttactccaactactccggcagtagcaaaggaaactccactggctgcagtcggaactccaattttgggggccatctctacatcaagaaagagattctctttctctaatgaaagaaggctatccatcaattctatggatggtgatgatgaagaagccatcttggatcaaccattggaacaaagacttatgtcctccagaccacctaaagagctctccgctccaagtgttttgatcaatttgatccgcacaaagaatccattcttgagaagaaacattctatcagttaaccaattcaagcgttctgatttccatgctctcttcgcagttgctcaagagctcagagctggtgttgaaagggaaggtgttttggacgtcatgaagagccgtgttttgactacaatgttctacgaaccatcaacccgtacatcatcttcattcattgctgctatggaacgtttaggtggtagaactgtcaacattaacacttctgcatcttctgttaagaagggtgaaacattgcaagataccatcagaacattagcctgttactctgatgcaattgtcttgagacatccagacgaaatgtctgcccacattgctgccaagtactcacctgttcctatcatcaacggtggtaacggttctcgtgaacatccaactcaagccttcttggatctattcactattcgtgaagaattgggtactgtcaacggtatcactgttacctttatgggtgacttgaagttcggtagaccagttcactccttgtgtcgtttgctacaacattaccaagttagaattaacttgatcgctcctaaggaattgaggttgcctaatgccttgcgtaaagaattgcaagattctggcttattaggtattgaaagtgaaacactaacacctgaaatcatttccaaatccgatgtgttgtactgtacaagagtgcaacaagaaaggttcgaaaccgaggaagattacttgaagctcaaggacacttacattgttgacaataagatcttgtctcatgctaaacaacagatggtggtcatgcacccactacctcgtgttaatgagattcgtgaagaggttgactacgatcatcgtgcagcttacttcagacaaatgagatatggtttgtttgtcagaatggcattgttagccatggttatgggtgttgaattataaaggagctaaacagattcgcgttcggaacttttttcagaatcaatccaaaatcaaacaaaataatttaaacatggaagtaaatcgttcattttactttaaattcatcagaaggaattccttaaactaagaaaactctttttttgtggggacttgaaaagagatatttaatcggaggaagaaaactgatgaaatatgactaaactaccttcatctgtaccatagtaatacaaggactttcatagtaggaaaataacttccttaaaattacaaagtgacttttatctattgcactttctattctttgaaatgctcaaaatttcagatacaattagtatattttgacatatatatcattttgtcgtacatatatagttcaaaggtttatccttacattcacatctgcatcgtttaatacattaatatttcgcatcgactttattttcattctattgttctcttttgtttgaacctattcagctgtcagtctctaggcaaaaccagcaacatattagtaaaaatgatcacgtgacagatatcaacgctttcccttctctgtcagaatatctcaaaatcttaatatgaaagacagttgtatttttttgatttgattaagttcaagtcatctccgatgatagaattgccttgaaatgtggtacgttgggctgaaataaatgaagtaccactatatacagatgctcagaactacttttaaatacagcatttcttcaatacgtttattttgcaataatcgggttctccagaacgaatcaagggctgtatcggatcttctttttaacctaccaacatacaatccagcgacacatcgaaagagcggtaacaattctccacataaaaatcgtgataaacaccgccatagaaacggtaataaagatcaacggaataaaaaacttgttttcagatggaatagtggaacagagaaacagcaggcagctgccaactcggtgctagaggaaatactagcaataaattcaaagggtaacatcaaggcaatcaatccagaaactagcaagctagaagaagccaatattaggaactttttgaagggcgttaaccttgagataaatgggatagctatggtgagtatcgataatgctgcgtccggagatgttcgtctacccattgtcaaagaagtgccaacaagacaggcattaaagaattattccgacaaactatctaaaattaaagaagaagaacttataaaattgggtgtcaatataaagaaaactggccgtcgctctccagactcgaaagcggattcatcttggaaatcaatcaaggtttcatggcaaatatcggattatgatttgaaaaaacagaaatgtagtgaaattgtttctaatttggaaaaaggtagcaagattgctcttttcattaatgataaagactcttctaacttgtcacctatagatgaggaggaattagaagcgatgcaggaatcttctatttctaaaaaggaaatgaaaagaagggaagaggttttggagaagctaaacgaaataatcagcgaatattcatcacagattacacaagaaggtttgatcaatcaaagaataattatgaaagtaactccaaatcttgtaaatactaataatggagttgataaaaaagctctcaaggagcaacggaaacgggaaaggcaggaaaagctgcaacgcagaattgagaagaaaaaaaccagcgattccaccgaataaccaggaaatatctcggacgatagacgttataatggcatatgtatcttgtaaatattgataattagcgtacatatatcgaaaaatttcacgtaattgtgatgtattctaatgaatcaataatgctccgattagcgaaaggtcatgtaagtcaccgtagccaaattgtggaatggaaactaataagtcatctaatggggactcagccaaattggagccgaaattagaccaaccctttttcttttgctcggggttaacgaattcaaggtgttttaaagcggttatgagcaaatgtttggatctccaaagttcaactgttctcttcatttctgacatagagacactccagatagcaccagcgccattaaaactgcccggagaagaaagaaatagccttttccgggagtgtgagaagtgaacacccttaccaaactcaatagaggacttgacagtgttaaggtcaactaatgtgtcaagttccaatattaaccagacctctagtgcagagttgccagcatctttgaatatgtagaccttattgaagagcaactgtgatattgcaatataatctacttgatcatgagtccatacgtgcatttctgcaccaaagaatccatgttcagaggatgctataatatccccccatttccatgggacgtcttcgctaggaaagatgatatcatcctctttaatgtaaaacgatggtggaattcctgtatttaattgttgtaagttgtatccgtacactagtcctaggctttgagcagtcacaaataaaaaactgccagatgctgcagcgttagccccataatgttgaaattttaaagatcttggtccgtttaagactatactcccgatattatctacaaattccacttgatttattttacctgaaaccaagtatgggatgatattcaatcctggaataattatcacctttcctagttcgttcttattacaatacttgcaagtcaaaattaaatctggtatctggtcgttgtcaagatcaactatgcaactaacttcttgatagctagacgaaggatccacgatagttataatcttctcaccaaataagtagatatgaataaattttttaccaggctcagaaacaacaagatagtcataattcgataatctgaacttatgaacttttgacccataaagagcagtcatttttgaactttgcttaccctcagattcaagtgtggacataggaatgacataaatggacccacttacatcatctaatggtgccccgactgcaatgcagggaacatcttccaagaattctccactgacaatgctggtaccaaatagcgacaacttttttaatggagtcacatatttattatcactgttggagtcttgagttgtaatagataaagaggatttctcactggattgttggacgttaaattgtaatccaattccataagtgaacttttgcaactctgctaagatattccactctcctcctcgccaatgttctcttaaaagtttcggaccacctggactcaacgaatacgctacgtccaaggcatgaaaccttttgttctgtaataaatagagttccgagtgcaagacaccaagcatatcaaacatatggccaacgatgctaacccaatcaccttcgatattttgctgtgataataggtcgagaacgtcttccttcaagggtaacttaatttgcgtagataagtaataattccactcaatattgtcttgaccaagtaacaaagataagtgaactaaatcggcagaaccccgtagatatctcaaagtatcttctatactacctccgaactctaagtttgccaaaatatttaccactccatggtcggtataattctgaagactgtttatcttatttcctaccgacacccctaatataaactgctttaacccatgatcatcattacctgtgccatacttttcttgccatagctgtacaccatcctgcaagaacacatcccaatctacttctaatttatcaaactgcagaacagactccagaaacaaagaaccagctttggtaaaggaatcgtgattagggattgacctagcaacttgcgtcaaatgaaaccctacgccaaatcctagaacaaatcgaacagataatatgactaaaacaattcctagcatgattgtgaactctcttatacagtaattgcacctcagatcaaagggttcaaaacatgttactacctctactcttccttctttaatttcatctctgctcatctcatctcatctcatcgcactttatttatttcaacaaaaatatcaaaacggtaaccctttacaaaataatcataatatatatatgtcagaataatcattaaaagaacaaagcaaccaagacaaattgacaggtaaaccacacatttcaggaccgtctactgcatttgtatgttttcttttgtacgacactttgatgagtggaaccttgctgctattacctcaggtgcttctcttccgaactggctgatatatttgtgtggtatttgtacaatagttgccacaagtatatccattatttcacaatgcgggcagttgtggaattatagaattccttcgcagcaaaggttgatattaaggatccagatgatggtacctatattttccatctcatgttttgcttcgattttacgaccagagataggcgccatttatattgatccgattagagaaatttatgaggcattggtcatctatcagttctttacgtatttgactttacgactaggtggtgaacggaatatcatcatcaacatcgcgccaatgtatccaccgagcaggcatgctatcccattctttgggcgttacctacaaagaatcgatcttagtgatcctcacgatttcgagacgttgaagcgtggtgttttacaatacgtttggttcaagccagtgtactgtatcggtatggcaacgtttgaagcgttccaatggaataccgtctggttagtaatatgctacaatatcagtgtgacatggtctctttactgtctcgcgatgttctggaaatgtttgtacacagagctttcagtattcaaaccatggccgaaatttatgtgtgtcaagttgattattttcgcatcgtactggcaaagtctcattatcaacgttttaacgattatagatgtcattgatatacatggtgacgacaaatatgtggcatttgagatcggtaatagtgtactttgtgttgaaatgattggatttgctattgcacattggtatgcgttttcaagtgacgaatacggtccggacaagtacccaaactctggaaggttgaagatcctctatgctttgaaggactggcttggttttaaagatctatggtgggatttcaagagtgtaataaatggtgattacagagattacaggagctttgactcggtggaatcaatgctcgcggacagagacacgcactcaagaaccaacagattgactaggggattaaggtacacaaatcagggtatgtcatcttactgggtcggatctagtggatatggcagcaccgaaactgataacgggaacgatttagaatcggcatggactgatatcactgaaggtttgaatttgccaaggtatattccagaggacagcaattatccagtggtctgggacgcaacatcacatcgatatgatgctagaattgatgatttgaggaaacaaatgaggtcgaagtaaatgttttttaagggtgggacttttgtattgtacttactagtgacaggaagagagggcagtcatgattttagaacaaagagaaaacagcagcaatagcgtttaattgtgggagaaatgacaaaatctatatggatatatgaaacgcttaaatatacatacaatatctacaggggatatatagcagttagaaattgtggaataaaagaccatgctgccagataaaaaggaataacaggggaagaagaaggtaaaagattggtgactctaaatataagcatgtcaagtaaaacgaatactaagagcacaacattgtggaattggggaggggtaagcgttatactttgtgcgtgtttgtaaggggggggggggggtcattagatcattcaaacgatatttataatgagggttcttgctttgtgaacaataaatgtttagcaaattcgtaagaggtccaggagatagcagttgcagggatattagaaataactcttggttgtaaacctctccagaaacctttccaaccgtaagattgccatatggcttgagcagctttcttgaaagtatttgcggttttgaacgattccacatggacggtatcgctccctctaatctgtaacactgtcttgatgcaatctaaaggcgtggtaacagctgcacaagtggcaccggcgataccaccacacaagcaatggatccaagggttgtatgcattagttgggttgaagaacttagtactggattcgtaaatcacgaagttcaaagctgcgaatgggatattcatagccaaagtggttggataactgtaaaagaaagccattggaccttcgttcttataaatgttgaaagccattctccacatggaagagtcactactcttggattgcaattgcaacctctgtttgattgtatcgaaggggttcattaatgcatctgcggccacagtggcagcaacaccactgacggcagttttcaacggctgatgggtattgaaatccttagcgtcgatcaactgttctttacaaaattcataagttgcaaaatatactgcatgagcagggcctgcacccatcaccatagactgcacacctctccacaacgcaagggacccctctgtagaagagattctcgatatctgttgtaaaagggtacccgcaccggcaccaccactggcagcaccggcaccaccagatgccgacgccgacgccgcagccttaatttccgatactgcttgcattctagtcttcaaagcatcgataggaaacatgatcgaatgttccatgatacctgcaaacgctcctgcaatcaattgatatgatagtggtgcagtatctggcaaagcctcataatcaatctcctgaatacctgggtcagacatgctaaaatgatcactctctttctctttttctatcagaccaaaactcaatcaaaccaagaaaaaaaatagcagagtgtttcaaaactaacaacttcttacctgattaaaaggattcggtggtgtattaagacaaattctgggattgttgatgaaccaaatgctgtcaaaactcggtctcttctctctctttctctgtatctatactgattgaagagtttgaatttttcaaatttttcacaatttaggctttcactctatgtaaaggaaacaaaagcgcaataaactggacctgaaatctgggtgaagaagcaacgacttagccggaggaaaaacggttcttgccttgctgaatgataccggataactataaactaatctgaatattcagctactgttatataattatctaaaattggatactgaacccaggaagggtatcaagatatattctccgtttatacatcaatttttcatcattacaatatattctctttctctaatgatgcaacggaaaattgacaaatgaccaataaatgggcgactcatctggcaccaatcgaaaagaaatacacgatgactgacttaattaatttaaccggtacagtacccagccatgtgatacctaaatttgatgccttggctcgaataaaggaacttaagccatacgagtgaacagggcagctttcgctgccctgttcactactaaattgcctgttcaaattggctttgccctttggcaatgacagattctatttctttttcttcctttaactactggcatattgagttaagaaacacctgggaatgatctccgggtaacgcggaaaaaaaacccacctcttgctgcaccccttttttcattgtccacactgtgctttgcccgattttgcgggtgtcgcacgacgacggagtttatttccgccgtttcaggcaagggaagagctgaaacggctgagtgacgggtggcggccgggtaaggaaagaaaatacactgattacataataccatccacgtgacgtagtcacgtggatggtattatgtaatctcagagttgaatgtccgaaagcattcttttttttttttcttccttccttttccttttcccccggggtttaaaaattccgttccgtcccgaccggcattcattatgcaactaatcgtcttttagattatcaaaatgtcaaatgattattccatttcgaccgaactaccgcctctccacttgcttacgtactgtttttgggttccctcatctaatagcttcctcaatcggctagaagtgccagtactggtcttcagaagtccatagaaagcctcactgttacccggggggtttgcgcatctgtcgctctttcactttttttttttttattcacttccattccacatctttcaaccgttagtggtctgaacttgtttcatttctttattcataatttctttctttcgtccaggttctgcatttattatatatatatatatatatgtatataaataaagtttgtacattgcttgtttcgatgatttgcggactagttgtcttatgtctgttgctcgaggagactaccaccaaccaagaaatataataccatgtcagtgtgtcaaacgaatcctttgaacactcttgtttcgaagtctggttataggttcggacagccgaatcagcaccaacagagcatcgcacagcagcagagcagaccaagaaataatgcactagaccaccagttctctcagtttactggtgcctcgggtcccagtttcgctcatccacagcatcaacagctgcctatggcagctgttgttgctaacgctactactgcagccagtactactagtaatactgctacagcctctgatcaccatgtttggatcgatcagttcgcaaacatgcaggtgcacgacaagaccgagttcccaacagattataaacagatgtattcgcagtacgaggcgcgtggcgcctcgtactccatgggtgcaccggtgatggtgtcccattcacaaatgttcccgcgtcatcagcaatctctgatggtgaaccaactcgagtcacaagcgtatgccagtagtagcgcgaagctcgatgaacaatttgctgaactggaaagacaagtgcaagacgatgaaaaagaacagcaacaggacaaggatgacgatttccatctcaaagaaacgtctcctctagacgaagatcaacgccaattaaaagaagcagcccaatccatttacacaactctttcagataaatcatctacaactagttcgaaattttcgaactccaagttccttggactcatgagaaatatcagcgatggtgtaataactctgaaaaagaacccagatgaggataaatatacggaattatattctccttctaccggtgaaacttttggcgaagagtatttcccagtgcaggatagtgttttaggcgaccccttggactccattggtgacttatctaatatgagttcatcggaagccgctgcaaaagtgtaccataactccgtttgaaaaaaaaaaaataaaatggtattactaagtatgagtggaggggtatttctctgttgtcagatctactgttattttgtcgatacatattgagttagagttactctacactcacgtggaaaatcacctggcaggatcaccatattctacttacttcccaatattagattaacttagctaaagcttagttccaaaaataatcttatttaatgactataatgatacatttcaatctcttttgcttgagttgatgattctgcctttcttgtgccgtaatcttccatattggtagcaagaccagtcgctatcgtgcctatagacccatcagcatcttcttcctctgttgctagtaacccaagcccgtttttaaactcatttactaaggaccaaatcgcacttcccgcattgtcgtcaccttttggcttgccctctgattgattttcagttgcactggatcccgagtcgcctaatcctaacttcgtttcaacggtcccctgaataatttggtcaaattggttgagtaatgaaacggattttgtccataacgagcttgatttgttatcagcggtttctgcgttgttactttccccatgggattctgcaggtaatgtcgtattagagttctgaccttgaacttgattccccactaaacggctaacttttttcttcaactgctgaagttcttctgcattctgttttattatcttatcttcaatcttaatttgcctgaaaagatcgtgaactcgccttgtcctttccaatatctctagttccttgttcgccagtgattgcaacaaagattccatatcattatcatcttcagaaacagatggcactactttggcggtgtcggtcgtagttgtaggcaacttcaatttagtagctggacttgcgctaaattctgtggtggctccatccgggagaagtgatccaatgctacttatgctggaccgcacagatttttgtccgtcatttcggtcaagttttgatcgatatttccgtcccagcggggtattcgatacagactctgatggtttgcaatgctgctgatatgattgacgttgctgctgcttaactgtgtgctctggagacattaatggcattattaaagactttcttttccatgtgttgcttcttcgtattcctagctcctgattgcctcccttgccatttgtagcagcagaaaccccgttaccattgttctttacggtgactttaccggaccccaatgatacatcgtcctcgttctccttcatattgccagtgatatcgtcttgatctgaattatcacctttcaacggatgcgagtcaagtgtgctagtaggatcagccttggtaggcgttaattgcaactggatgttcttgtttctaccggaactccccacagacttgggactcataccgctggatccttggttaaatgtaggggtaacgctccctctgtccgtaacttcatgatatattttactcttagtatcaatatcgttctctttgtcttgaaggtctataaatttctccaatacgtctctatccattgtttatacccaaaccgtacacataaagatctaatttgattcaagcctagcttcttactacggtcagatcagcctttttacccttatccttaacttgtacactaaaatcaagccccaaagttactgattgaaatgataatttcagtctttcacagaatttcgtgttgttatgaaaatgaaacagtgtaaacttgaagttaccagaaatagttcagacggctgcaactttttgcagtgcgtaacagcttgaggttcccagcagtggctttattacaccagttagtggaatcaaatactttgcatatcacatatctgatttatcacttgctaaggaactggtattgcgtatttagacggttacaaacacaagaatggctccattcaaatttggaaagaaacagaagaatcggaaagatgcttctgcatctccaaatacaacacctaattctaacagcactattggtaacactagctttcaacaagaattgagatctcctggatctagttctacacctaccaaacagaactatccaaaaccagctgcagattctgggttacttgcggctcaacaacgcgttatggtcagtcctgttgagcaacgatctacgtccactcagagtaccctacagcagcaggtgttcacgccatggaatagaattagactaaagcagtcccctttccccagatataggcatgttgccagctcatatgctactgacagtggagaattgtttgtaatcggaggtttgcacgaccaatcggtttatggagatacatggataatcaagtcactggacaacgctacaagtttcaagtctattacagttcccattgcagatgctactccacctcctagagtcggtcatgcctccacactgtgtgggaacgcattcgtgatttttggtggtgacactcataaagtgaatgatgccggtttgatggacgatgacatatatttgttcaatatcaactctcacaaatggaccataccaacacctcaaggacctagaccacttggtagatacggtcacaaaatcagtataattgctgcgaaccaaatgaaaaccaaactttatgtgtttggtggtcagtttgatgatacctattttaatgatttagcagagtttgacctctcatctttccggagatctgattctcactgggaatttattaaaccggcaactttcatgccaccacccttggctaaccacacgatgatctcgtttgatcataagttgtgggtatttggtggtgatactcctcaaggtttaactaacgaagtctttatgtttgatccagctgccaatgattggtgtgtagtgcagactacaggaaacatcccaccgccattacaagagcatgctgctatcatataccgcgatttaatgtgtgtttttggtgggaaggatgcgcaggacaattattcaaacgccgtgtatttcttaaacttcaggagtctaaaatggttcaaactaccaacttttaataatatgattccaagagcaagatccggacactctctcactctgttatcaaataataaactgctaatcatgggtggtgacaagtttgattatgctgttggtaacagcaccgatgtacgcacttctgatgtcgacatgggagccggtaccattatttacactttggacctaacaaacttgaatgagttttgtcctgacatctttaagatcgatgatgttgatcacctggacaaatttagtacgccattatcgaaatccaatggaagatttgatgaattgaaaaacaaacaagcttcaattctatcaccagatgtaccagaaacggtgaacacaactcctgcagttagaaaacgctctgagtccggcgtcctcggacctactgctcctaaaccaaaatcaccagttccacaacaagatgccaatacagatcctccaagagtattgtccttgcagtctcagttaagttcagagacgcaaagtgacactgatcctgatgttgggtctgtagaagttgttcagtatagaacttcgccgacaaaaggtgatgtaaaaaaatacgctgttggaaccaacttgagatcctcatcggactatgaaaattattcaccatctatcatgcataacacaggtgctgagccttcgcctaaacctaactccttgtcagatacgacgcacttcgataaatccatagatgtaataactgacgctgataaaagccctgtcactttaagtgaacctgctcgtattgtttctgaaaagaatgaaaacaacattctgaaagaattacttgaagagttgaagcaattgaaggaggatactgtgaccagtgctactagtgcaaacagcagaataatggaattggaactagaaaatacagaattaaagcaattgaaccaattaagtcacttgaatgacatgattaagcaccaaacagaagtaattgccaagctacaatcagaagtcgataataaggagaaatatgtggatttggaatcaaagtatatcgtattatctgagaaatatgagtctctcacgaaagaactcgattcgaagaaacagttcatcaatgaaaacataaaaaaatgtagtgaatcgttggacactttgctcgatggcatgagacagaaacaaaaagctcacgaaacagttgtaaccaggcataaagaaacaatgaccggtcttgatcgcaagttaagcgaagtaattcttcaaaataaagaactgactacatccagggaccagttgttcacagaatactccaaattgaaggatgagcatgcctcaaaacatgaagaactgaccaagatggaaagagagtacaggtcagttattgactctgttcacaattctgggaatgcgatggaaaagctgcagaatgaaattatcaaactaagacaagaaaattcaagacttaaatcggatttagagaatacgattaaccaggaagcagatgattcgtccggttctttgaatgatgctcattatcaattaaagataaacgaccttcgcgcagaattattcattatcaaacaggaacgtgattcgctaaaagacgatgtcatgactctcaaaaagaaactacttcattctgaagcaacactatagactcttaataatatcaaccgtgtaaaatagaatgtattgtttagatatatatattttcaactattttaatttgttttatattcattacaaacaactattcactgatactccgtgatatatatgttttatctgctatactgtacatcagtcgaaattatgaaatgtcaatgcatgtttttgtcaatcgtgggaactggataaaatgacaggtggcggactactttgagttgtcatatgaatttcgctatccaaaatggaagtctgcagagtctcactctgaagaatggagcactgagatactggtggcactgcatcatccgtctctaatattgatcctcttgatatttctgtttgagctgaaatgattgaggcccgactagctggtacggaaaacttcggcggcaaattccaatatggtattctgtgctcttttacagctggtttcttcgaataagaaggcaacaaggatgatgcgggtcgcttcttctcacaagctaaaatatctgcttctttttcattaaagtttgccttgtccagacgtatgacatctgtgttccagccataaaattcgcgtaggcttgatggaatcctaaatctctcacaaaattcagttaccgttacgatatcatccatgaggccctttatcacacgacaattatgattactgatagttcattcaattatgaacgttttggaaatttatttcggcttaaacgtgtgttagccgctgataatctgtccagtgaacttaaccatgcctgctttctcctattggtaaaaccatgacggtacttaattccgggtaataaaattcttcctcaaaaaaaatactccgaaccacgtgatagccccaaaagaggaaatggttgtatgaacagcttttcaattctcagcaattcggatgattctattgaaattaaagcactacgaggtttttctgtcgggattatttttcatttcgaagtaatcattgttgaacccttgaattaagtgcgaaattatacacatgtaaaacaatatgacaaggcagtgacattcttgcggtaaacgtactttgattgtctttggctcaacagccaatgattagaacttactagcaaagataacgtgaaaatgctttagaactggtttttagaagagaaacacgggtttcttttgtaaatgaactcggttaattcttattatcgaaagctgatgtccaaagtacggtctagggtcgttctttggcatgtactatcttcctttttttttctttttttttttccaagtgttcaatttctaaagtcggctgaagaaatatcgactcagggaaaagctaggatatggaagcagaccatacaaaaatatctagaaatgatgagtgtgggtttttttctcttgtgttaagcatgcggaagattttagaatttggatcccttgtacaaagcactatttgatatcttgatgcaaggtaaatttattttctctatttgtctgagttaggctgagcttattagggataaggtgcagagaaagtataagaagagattcatatctagcaaacatttggataaggtcgccaattgctcaccggagttcagaaacctgttttttggaatcctacaatataaaattacagtgtgtctgttaaacaaattcattgaatttttgacttcagaacccctacctttggactacccatattaagatcacacgctaaaccgaattctttccatctaagtgatgtatattaaacatgtgtcttttcaggatctatcgccgtcgttgatagacgatcaggcacggtctttgaaagaatccaataaaccgataacgtacaataacccgttcattcatgttccaccgcagttcaatccattatatagtgatccaagtgtgcgagagggttctcagagtgagagtgtttcgaacgatagtggagtgcacgatttcagcatgaaaaggccacaattatctacagacctgggtttctgttcttctcaacaagacgttggactaagaaatatgctaggacccactttatcgaatgacaattcagagtatggttctatgaatgggctccgtagaagtaagaccggtatgtcttctgtctctagtgcgagtacctcgttgaccagagctgctacttcgtcatctgctaagttaccacctcctccagcagtgtccatattgaagcgggattcacttgatgatctgcatcgtgaacattcacctgatgggattgacttgacagtaattgatcctcaaatggagaaaagaattgaaaaggtaaccacgtcaaatactctggaaaatgcaggcaacaaatacggatcgggatacactacgtcggcatttgcaaatttaaacgaattagaggataaattgataaagaaacaggagaaaaaagcggaaccagagaaaaggaagaagtcttacatggatatgacagatgaagaattagctcagttggaaaaacagcttcggtctggtgggagggaaaccaatacagatttgaacagttttgatttcagtcaacagtataagctatacatcggaaacaccgttgttaaaccttctcccagtagcaagtcgtccggagctggtggaaaaccctctgatatgacattaaattatccatcacgcccatcaataacacataaggccatttcaattacaaaggaacatacagactacaggaagcgttatacggatacgaatactaggacagttgtttgttttttgaacggtaggagacatacttgggcaactgttgattggttcatcaaagaagctgctagagatggtgaccatttggttgttgcaaccaatctaccaatgtatgaagagttgattaacatgttgaaaaagaatgaatcttccgaaactggaagcactaaaacaaagttggaagaattcacgttcgatggtaaaattaaaaacaaaacaccaagtgcagttgtacagttaccattccgccaagtgggtatgataatcaacgaattggatcaacttacaagatataaatgtgaaaatatgttaaactactatgcagcgaaatgtcaggacaaggttatgaaaataactatagaattggtgaaagaactgtccgcaaaaccgcttgtcacacatgttatggatctttacaggccaaatttccatgttgtttccacaatttcgactaacttaagcatcaagttcaggaatgggaacgttaaattgcccaatttcctttatagacatctttgggttcctactgttataattccctttgagtttatcgatccatatcatcttggtgaagccaagaaaccgatgcataagactgtttcgatttccacaaaagatgatcaatttgcattcctcgatagatgtatcatcaaatccctgaacgatgttttgggtactagctctaagaatgaccacacacctaggggcattgaagacgtttatgaacatggaaatgacgatatggttagtatagacagtgaggcagataaaggaattacagactatttccccacgtcgcccgaagcgcaacggaggaagcaacacatagaaagattgggatacgttccaccagagccaactaggttcaagaataacagttttggtccagtagcttccagaaactcgactatgagtagtagacggtcatctagagtttattttgccgatgagccaggaatgtataaagtgaaatcattattgggaggcgatgacgattcttcgagcatagttagaagagtcaagagcgagaaactgccatccgtctccagcccaaaacggccttctacatcatactcgtatagtgcaaaagtacatccgacctctacaacaaacgggaaaggaacaaatagaaaatccaattctggactgaagactgctacaagtggaaaatcatcgatctcatcagcacaccaattacattccgctacaaatggttcaagtgcaagcgctcaaactcaaaccaaatcaaaatcaaaatccaagcttggtggcatgttcaggaaaatgtttggcgtcaagagcaacgctgcctaaccagaaatacaaacacaaacactaaaaaaaaattaatcacctgttgcgccttttaactccatctgccttgacaacattcgaaccttactactattaattaccaagtctacaagcagcaagatgcagacggataaaaagattgaatatcaaccaaaaataacacgagtaaatagatacatatcgtcagtatttttcaacatagaaaagacgcggcctccatcccatattcgaacgtatccaatcaagaaatcgtaagaccagaaaaatgcagcccatagcctttcttgaagaaaggaaacatttagaaagaaagattattactctaagataaaatccttctggacactggtgagtgcatggactctgaacgtaaacacacgttacttattcaatctcacgtcactatctcctttttgtgactggattatccccatgtttggatggaaaagggaaacatgatatgaggtgtctgggtggtgtccttggtgattatataataaacaagggttgtgtgttacccggttttgtttccagtagcagaaactgggagaaggtagcaagagaaggatacggaaacaagtgcaaccggtactggaagctgtgctaaggattgtttaatgtaatggtaattcctgttccatcacaaatttgattttggtatcaaagacatggattgttatctattcccctgttggggtatccctgattcaccccctgattttatatagtgttatacaatgaatatttggaatatttggagatcacatacagatatatctatatataagcacaagctcttctctgattcttgtcctttttccagtatatttccagcccgcaacattcgatattcgaacacaatagtttgacaccaactaaacatcaaactgtaagcatattgcaatgactatcttttcaaatctattcggagcaaaccaacaacagcaacaacaacaggagactatgtccaaggacatgtctcagaacttgcctcagactatgtcacaaaacacaaatcagacagaaacaagtggtttaactagacaaaagactaatgagtcagaggaaggtgaccatattgatttattcgcaaacgtacgggatattcccgtcgctgcttggcatattcgtggtagaaataagtactacaacgatgaggaatataggaaattggtagaagaagctaacactatcatgttttctagtataatgtgaagaatattaattgttcttttcgttatacttacctaatgaaacctcaaccaatgaatttctggtaaacattaccatcaggtgtgattggttattggttatttttgcatattcttataatatttctagctgacttttataagtaactaatgaatgaatggatgaatgaatttttgattccacgactagaattcagtggaaattgtaaaccttatttggttattacatagtgcctcgaagtgagtcattagcttactgtgtccagtgtcggtttctctcgtctaagctaacttaatcatctccaatgatttgcattggaatctttcctccagtcggatgtatcattatgtacggatatatccgaaaaacgtacaaactgaacatcaaatggtttaaacaacttaaagatgcttaacaattgagttaaactattcctttcctttgttgttctaatcaatagccttcgagagcccagcgatttaccgtatttgtaaaactcctgctagtaactgacaatggctcccaatttttaccgtgaggttgacttggtcaaagaacaagtgataccacccatgtccgaagtggttctgtcatcaaacgcgaaggaagctgcaccacaaaatattgaatctaagaaactatcatacgagttacaagatttactgggagagaataaattggcctatggcatttcgttgaggactccggagccattgatcaatttctttggcgcagtacgtggtaaattgagcaatggtttggaatttgtagaaaataaaattgatcgttcgtctcaggcttactatgacaaagagagaaaagtcacatctgctattgctgatcttcatagtgatcctaaggaacaacttttacctggatttacctacattctagtggcttcaatgtccggatccatcctaacaaggaatagaaacattttcttaagaggggtcacaccagtagtattcggtatttcatgcttctcatacgtccttccaacaacttaccgcaatactaaacgtttggcatacgacatcgagaaacggaacttccctgtctttgttagtagacaagataagctatacaatgccactatgaaggcagcttgtaatactgcgtattacactaaaaatgttgctgccacggtcaaaagaggctatgagagaacaaacaaagctattaaggaatggactggtttgaacgtttgatttctagcattgattctttttcccttggttgctccaatcaacagtaacaaggaaatagtaatatctttgcaataacctcacctattgagtagaattcaactattcgataaatcgttacatatactacatattcttataccatcgtagccattctggggttacattacttattataaatgacatattcatgatcttctagatttatatccaagtcgaaaatgcttttcacgcaccaattccattcaacaacaaaaactttcttattcttgtcagcatctttaacgcacttattgaattttttagccattgacgctttactagctatgagaacatagttagggcttttctttttgctcttgttttcaactagatcctccaattgaaatttcttcccaatagcatttacttcttccatgctatggcattttagaatacttgaaatcaatttgtatccccccggaatatcatcagaaatattcacatgagtaaatccatgtctggcaaacacttttgtcggtagcttggttctttctaaaaccttagaatcaatatcggggatgaagtatttactcatttcgagctctacgggtttctctttattgatgtttgttagaatattggtaatgaacataggcgttaaggcatatttcaatggtttgaaactaaagcttttcaagaatttggcagttctggccttctttggagctatgatggtattagtgaaagattcaatctctggagttattatcactccaattttgctcaaaattaaaatgtctaaattagataaattctcatggcagttggttaacactgcctttatcttgtatggtttatgcgatatattcaagtaagaaaccatttcgtctgcctttgaatctagagctttctgcttctttatctcctgaatcgcctccgggagtaattctggggatcttttacgtttattgatcttctggaactcgtttaatgactctatatcctcgtgtaatttttctgccgcttttgccttcgctcttctcctggtgtcactcattggggttaatggctgagatgggttttcgaggctctcagcagcagataaagatgataactcccttgatgttattggtgtagcaatactgcctttatcattttttgattctatagttccattctcttgatgtacagacatttccggtgattccacaggtgtactttcttttgcctcttcttgtaactctttaggaaatttagttaatgatgtatcattattagaagatttgggaacctgcgtcacatctccttgctcatcttctggagcattggttaatgacacgtcgtggttagatgatttagaggtttgagtcaaatgttcttccgctgctggtgtggtaggcattgaaatgggatgttctttgttcagctgttgagaatctcttaattcctcttctggaggttcctgacttggtttttcatccaaatccgattggttttcgatatgatccatcaacgacatttgacccaatgatcgtgacaaacctccattaactggaaactgctgaaattcctctagttgtggatccagtttttgtccacttttatagcactgttccaaccataaatgatttgctgcggtgcaacacgcccatgcacgcgcagcttcgaatttttttccagaggcaatcggtgaaatcaaatgcgtattctttttcgtcaactccgtgctacagataccgcccaaggcttccaccagcagctggatgtaatatctttgctctccataataattcgtataggttgctttgagttcattatttgaaaagataggtttcttcaatggtgataacaagagtttggacattggatgtataaatttatgcatttgccatacgtaaaacaaccaaggaatgttagcacatactattctacattcgtttgcattttttacaccttccgtgtttgccgaatagcctatataaagatcggcttgagattttttcaactgactagggccagctactaatgtaatttgggcacctaagcattttttgatccaatttaataggaatttataactggtaccaggtagggctaaatcgtctcccagtattatcttttttcccagctggaaccctggtattaccttccaatcatcaatactgttcaatgttctatcccagagcttttgacttttctctttcaatgcaagatcatcttcattaacgttgatcaaatattcatcttccttgatgtactctaggccacatagacagtccaccagccaatttggcatcaggtatatcactgtatacttatgaaacttctgcatggccttgatggcaacatcattcttgtcccacgttatgatatgtgtagctttcgtagacaaataatccatgcatgtaccaccaaaaacggacactatagcgcagtacaattgatattcaacaacgttaagactatgtttagaaacataaatgtaacaatctttcaagaaatgcattggatcaggtgaatagcaggtagttctcataagcctcttgaattgtaaacagtggtcaatccatttgggatccacgactgggatcaagaaatcaaaagctgctgtacggtaaaaactaaaatcaattgatttcgatattatgcaatgtatttgttctgaaaattgagataaaaactgccctttgtccacatatgaagtattattggtttcatcctgtgataagtcataaactacgcattccaatgcaccattctttttcgtagtgttaatgatatcatcaagagcatccttagatagctcactcgatttaacaaccaaaattcttagattactaaagatcgacgattctgacattgctgtagcttttcagatacgtggatacggcctaatatgttgtcttgatagtgaatgttgagtttgtctatgatcttttcaagatcctcgttgtaattaaaaccatatatatgtaaaacgtaaatatgtcttctgttattatttttcaaatgatcaattttcatgttacgcgttataacggcgatcatcggaattgaggcaaacgcagcgaaagaggaaagaggaccatttgactcaacacctgccttcaattgcatcgaagtgtctttcgcagccaatcaatggttttcgaacctgtagagagtatctggtaaatgcaatttaaactatctctctagcacaggactttgtccggacactataaagaacaaatcatcattaatcccaacgtattacgggcgtgtggcgtagttggtagcgcgctcccttagcatgggagaggtcttcggttcgactccggactcgtccattttctttttttcatttcagcattgagttgattccataagaaaaacaaaatgtgtcaagacagaatttaaccgctcaaccttcctacattaaacaaacacgacataaggtataataggttttagtctttcatataccattcctaatgaagatcgttggtcattataatgtcttacatgtaccgaaaaccgttagagttgttgtacttgacgttttagaaactgaaaaagcatgcaacagagtatcgcattatgaggataaaacaacaattgctagaagagaaattgaagatgttttcgaccaaataatagttgaattttccgatgttcaaacttttaactttgatctgaaaaatatgaactatccgctatggttttatgataggatcttcttcgaagtaacccgtaaagaaccaatccagtattttgtttctgaaagaccatcagatatatcagaaaggatccagtttcctttacaaagtgaaccttttcaatcggtattacaagaaaatcaaacaactcggaatttcacagttgacatggatgatgtggagtacggggaaaactataagttgatgttgttgaaaattcttgagttggaagaagttgacttgactaatgacgacgaaattagtgatattctctcaaaattcaatagcatacaagaatatctacaagaggttaagcaatgaaacgcttagagatgattaggtacacggattgccgatcattttgcgttattgaagggtattcggtgttacggttcgtgcttctatagaaactaaaacatacctttcatttggcatgttagtctgaggaaacaactttgaaaggaacggtggaaagtagtttacaagatgcgagcttcaagatacagtgaaatcatatctcatcattatgccgaaatgctcccgaaatctatgacattgtggagttacgagtggcatacaacttaattcagtttaatgcacgtgggaaacataataggcaaacttttgctgcatggacaaaaaaaaggaactttccgtcttcgctctcaaattaataccaatcaggcatcccgtgaaggcatcaatggcaagcacaaaaaaagagcccaaataaaagtttgttggacaacgaattagcaacgtttttcactgatatcttagtcctttcatcgtgcgctctctttctccttcccttttttattaaattgacatagcagtatttttcgagcttatttctcttctttttttgggcttttttgttcatttcaacagagcgtgtcaagaagactttaagtaacaaagtcacaacggctagaaactgtagcacaaagaaggtcacgtcaaacaaaaacaaaaaaaataatgaaggaaaataaagcaactacgaacagaaaacgatgcaccttaggattgttctgtatgcctgagtgcgtgtggtaatgattttggcagaggatttcaagtaagttatgagacgggtgcttatagggggattgggggattacaggaattgtcataataattgaagcacaagtagaatacagaattgagaaaaaaattcacgggaaatgattcatttctttgttctgttgtttgttacctgagagtattattttgaagaacacagttgcagagacgtaaaagaagaaaaacaaaaattcacattgtgttttgaaattaatataagtataaggtagttttattcaggtttgttcttagcaagaaggaaaagtagaagtaggtgttgggaacgtttcagtccgtgacttggaacctctttcagtgcttttccattaaaagcttgactttaatattgtacatcacgactgtgcaggaaatccggtcgaaacagttgggatgaaatttggtaaacaccttgaagggagacagttagaacttccggagtataatggacatttcatcaattacaaggctctaaagaagttgattaagcaactatctgttccagcagtttcatcttatacaaattcaaatgattatatgacattggatgaaacggatgagtcgatacggtaccaaagtttacaagagaataaagcatctttcttcttcaaattggaaagagaattggaaaaagtcaacgagttctatctcgagaaggaagctgatctacgtatgaagttcgatcttctaaattccagatactatgaatacaaatcgaaaggaaagttgacttcgaagaaatctattgcgtataggactataagagatggtattaagaagtttgaaagagatttggcacaattagaacaatttgtagagttaaacagaacaggtttctctaaggtactaaagaaatgggataaaagatcgcactcgcatgcgaaagatttttatctcgcaacagttgtctctgtacagccagtttttaccagaaatgaagtatccaaatggaatgatgcagtgtcctcattattaatcgaacttgacgaactaagtgataatgatgatgtcactggacccaatttctatggacctgcaggacagatttcccggacgatatcacgtaactcagaaagtggtccctcaatgtcaaatatcattgctccgaagcctgaaacacgtacatcagtcagttcagataaatcaacttttctcattaacttctcacaaggagcatcaagtaatgcacatcattattcaacttccagttcaacagctggtttgtttgatatagagttggaaattgaatcatggtatatggaagtgttgagcatcagcaaattgaaagatgttgaaccaagaaaaacacatatcagaactttcgtcgaaactaaagtacaatcctttgtagactcacatctatctgctactcgcattgataaaaatctggttataagagacagcatcacaaagattttcaacttactattggctagcagcattgacgatgaatccttagaagtgttctggaaatatgggaatgaatacattgatcttacatatagtgatccagatgatgatctagtttttgctaggcataatatgtttcacgaagcggctctgtgtcctcatcaaccgcgtacgtttgttcttttggcagcactttatcaatatcaaaactccattatacagcaagaggcatttcgtaagttactaaacgctcaggacattcatggtaggatgccactgcattatgcctgtgaactcggcaaaacaaatttcgtgtctctattgataaacacggaactcatagataatattgatcttttggataatacatctaaaactcctttggttctttctattattaataatcacattgaagtcacaaaaatacttatcgcacaaggtaacgtcaatttatccccatctttgtgtgaaggcactaagccgcaattccatccacttaatgtggcttgttcaaacaaaaattatgaagcagctaaagttattctagaaaagggtgacataaatttatctagattaagagattcccaaggtttatgtcctttgcatattgtggcaaaaatgggcggtggatcagaattgataaaacttttggtttcttatggtgcggatccagatgagattgatgggttcaacaaatggccaccaattttctacgcaattcaagaaggacacgccaccaccgtccaagtattattagaactaggtgcagacgtgttcatgaaagatcaacaaaacctctcgcaagttttctatgcattatgggaaggacatctttctgtattgaatgtacttttaagctatgctggaaaccgcaaacgttatagcgccttcccagatagaccactcgctggaagtttgagaccatcagatcccggggaacttttttctgacgatcaactgtccctgaatgattcattaaaggatattccagatttcaccttaccaccaccaattatccctctaagaaagtatggtcacaattttttggaaagaaagatttttgtaaaactctctttcaagccaggaaaggaatcaatcacgctcaacaaggacgacgaaatgatgttatcctcacctggacgcatcactcttacttctagtgtatcgaatatcattccaagaaatattattttgcctattcaagaagaggacgaaaaagacattgtattccagatagattccctagatactttcgatatcgatattgaaatatacccttctttcggaacaagactcatagcaaaaacatatgctctttctgatgttttccacaaagcttatgaaagtacttgtaacaaccatcatttaactttgcccttattcgacaccagattgagaaatgttggtaaattcgatgttgactttgaagtaatcttcccatacggaggaaaatctttggaagtcactaaatatgaaacttattggaagtccacaagtggtggtggagctaacaataataatacgtcgttgtccacatctttgcaatccattgtaactgcatcatctttaaatggaaagtattgtaccattggtgttatacagttaaacgatggtactttgattgcaagtactagtttaatctgtcatgctggggatgtgccgttactatttaacgatatgaacgcaaaacagctaaacagcatgcttgatcagcagatatctgatattccagccaatataacctccaggctaacattgaaaactcttttgagagacagatatgtcttatttgaggatctattaaataatgtcgacccacaaattcagctcaacataaaggttttgttcccaacagaatctgagatacaatctataccaatgaaagtttctcctagatacaatttgaattgtttcatagaaacagtcttatctactacgtttgaacatgtaaggaaacttcgtcaaatgggatcgacgagatcaatagtattctcttcaacaaatccaagagtttgctctatcttgaattggaagcaacctaatttccctgtgttgttcgatatgaatgttatttccgagaatagtgatggtgatttggtgaaaattacatctaatgacctagcgtccatggcactcgatactaaagacattatttatggtgacccaggtaccatgtccataaaggatgctgttatttttgctaacaacaataacttgttgggaatgatccttcctataaatttgttggatataaccctacagttggttgatcaagttcttggccatggtttatttttgattggttctaccaatggaacaatcagtgaacatgaacaacgtgaccttggtattaatggtattcaatataaggaagaattggtcatccatgaaaactccgaaactgctgatagggaagccaattttatttaatcttgcattttgtttttttagaatcttctacacatcaatcgttataagctcaatttaatgactgtttcaggtatataagcatacattaactaccagccccttcgaattggataaatcattcaacctttgacaaaaagtaatccttcacttttgcgtcaacacagattttatctatggacaagtcatcgttgtcggtttctccttcccataatgcatgatacttgttgaccaacgtgacagcaacatcgccgtgaccttctgccaaagcatggaacaaaggagaccatccgtttttatcctttatattaacaggagagtttttatcgcataatatcgacacaattcccactgaaccggaagctgcagctctatgcaaaggcaattgaccaaggccatctttaattctcactgaagctcctctttccactaaaagttgaaccacatttaaatgcttcttagagcaagctaaatgtaaagcagtgatcccattattagcctgtagatcaaggtttggttcaacagtatgattaagtaacttttcaagaatagtaacgctaccgatagaactagcaatgtgtaccggagaccaaccagattcatccaaaatagtgtccaaatcaattttcttcatataggacaacaatatatcaattatgttgtcttgctggaatgatactgcccagtgcaaaggatatcggccatcatcatctttaaccttcactgcgcccggaaactcacttaatatctgttgaaccttttcggtatctccgttcatacacgcagcatgtaacaaaaagtcagcacccatagtttgaattgtttattgtgctttcaatgttttacaaatacactgatcccaggacagctcttgtatggttctgaccaaccaacgcttgtatgaaataagctgtctttaagttgaaaccctttttaaagggtttttacctcatatcaaagaaataagaaacggcagtggaaagacttggtacacctggacgaaatctgggtacacatttggaaagctgacaggttttaagtactaaataggatacttatgggtctcagataacattcaacttcccggtgcctggctataccaccatgagcagaggctagagtgttgatgttttatcacgtgatccgtgcattgtgacaaacatattttcggggatgtcgccccttctcagatgttaagtggcaaagtgagaaatgagcaactcagttcgttgtttgaaattgcttaaagggaaagggttcaagcaaaggaactaggaggttacgacaatcgcagcagtaatattatatatataaccgcacattgcccttttctgattggctgtaaatttgaaacaaaagctgtgtttttaccccccgcaaagttattataatttaatcaaaagaacgcaatgaacagatatccaggtgattttggtaagtttgccagatctgtacaaagacaattggctcgtgcacaacaatcaggtggtaaatatccttccggacagcctcctcgtggtgcctttggggctttaggtggtttatttttgttgattggtggtggatttttggctaacgaagctcttttcaacgttgatggtggtcaccgtgccattgtttattcacgtatcaacggtgttcaaccgagaatttacccagaaggtactcattttatcattccatgggttgaaaacccggtcgtctacgatgtgcgtgccaagccaagaaatgtatcgtcattgaccggtactaaggatttacagatggttaacatcacctgtagagtgctatccagacctaacgtagagaatttaccaatgatttaccgtactctcggtgttgattacgatgaaagagtgcttcccagtatcgtgaatgaagttttgaaggcggtggttgcccaatttaatgcttctcaattgattacccaaagagaacgtgtctctagattgattagggaaaacttggtgcgtcgtgctaagcatttcaatatcatgttggatgatgtctccatcacttacatgactttctctccggaattcacaaactctgttgaagccaaacaaattgctcaacaagacgctcaaaaggctgctttcgtcgtggataaggccactcaagaaaagcaaggtatgatcgttaaggcacaaggtgaggccaaatctgctgaattgattggtgaagccatcaagaaaagtaaagattacgtggaattgaagagattagatactgctagagaaattgcttctatcttatccagatctccaaacaaggttattctagataatgaagctcttctattgaatacagtgaccgattctagatcaaagaactagaggagcaaaactgaaacaataaattaacaccaattcttcacattcaacgagttaggtatcttatttatctcgtatgtatcttgtttatagtaaaagtcaaaattcaaaacaatatgacgacgagttgtaatccctatgtaaaaatccaaacagagatgttttcagaatatatgttaaaaactgggggatatacaaaggagcaatcattgtgtttcatatagatgtcgtgcacatttcatgtctaggtttatgatgcaaaagttgatataagttgaggcaagtttcggacctgcctgacttgaagtaaatatgtttaaaatagcgtcttaagagcaaagtatctcaaggaatgtagtcgcagaagagtatagggaggagtgggtatcttggatcatgttaaatttaaaactcttctgctaattgcttcgactggaaattcaacttggtaggattgctctttgcctggaacaacttcgatctgtgatcgttcaacttctgggaacatggagagagcaaatcatcggtaggagaagcaaacttgttcttcatttctgaaagctggtgtggtgatggtttcttaaacatggccttgtgcaaacttgtactcgcagtttgagaatcctgtttctgatgtaatggttgaaattggccggcagtcattattctttgagctactttgaactaggcttgtatctgtttgatcttatttagtacctggctcctgaatagcagttttataggttgtcgtgatgaacactgtaatgtggtttctacacatgtagcattgcatttctatgactttatatcactatttcaatgtttacgtttctcctaattgggaaatctaagtagtgtattctttgtgtcggtcacatgacagttttgagtcacgtgaacattggaaaatgtataccgtaatttaatcattaagaactacctgttgttcaatgaatctaggatacttttctaggtatattgtggttcctcaccgaatcccgaatccaagtgttgtcaccttccccatttctatccacatgatagtcacgtttatctaccgttttcggaaattctctatttagaatcgaaaaaaatcgtgtcgaaaccttggaaaagtacagaatacaaagagatctgtctaatgatcgaagcatatgtcctcaggtaagtgtttacgcgagatcaataaagttcagaagcaaattagtaggatttactaggaattgacatagtatcttagtgttttaagtgagaaaatctgattaatatgcaagcttttaagaagaaattacagcaattagtgtattcttttagtaccgaagatcggtatgcggattacgatgaagaagctgccaatccagatgttgctgctggagtagaacggtcgataactgaatctaaccatggttcccaaatccaattggcggattatgtggatgggtcgaaccccagtggcaacgagggtatcaatgaagcacttttggcatggagacatatcgataattggacgtcacaacataatcctgatttggcagcaacgttgagtgacccatgcacaagacacgacatcaacaatgctgagaaggatttagatattattttccccgcttcagtaagggcatctctaaggttgcatgatggtcaagaagatctagtgtcgatgacaggcactgggggtttgttctttgggctacagttgatgggactagatgaaatcgttcaaatgacaagaacgtggagaaatgtggctgaaaatttggaacgtaagaaccatgagttacaaattaagatggataaacatcaagagctgaatggcaccactgttgatttgccaaaccaacaaaaaggatacggtaaattagaaaaccaagattacaaagctatggatccaaatcttcaaaggaatatttcacaaaactataagaagcagttcaagctaccagatatcccagaccaacattctgttccgccattggccattcaacaagtctatgctaactcagggtggattccattggtaacggataatgcagggaaccacatcggtatcgatttggcaccgggaccaaagggtaaatacggtcaagttatccttttcggaagagaattcgatactaaatttgttgttgcaagcaattggggtgatttcttgttaagttttgccaatgatttagaacttggtaattggttattgatcgatgaaggtaacgaccagtttgctggtgaaggtgaacttgtgtttagagacaaaaagagtaatggcccagttcgagattacttagaagttttggtaatgagatcaagaatgaagtggaactcctttaccgaaagaaagctgcccgaagaacctaaaagaactgtttcatcatctcaagggtctcaaaatactgtagaacctgcagaacaacaggaaacagctttgactgttgatgaaactttggatgagaagaacgacacttccttatctgtagacaatactggcacaaaacaggaagttaaggatcctgaaacgacaggtacaaagacaggatctagcgctaaagcggaagacaatctaccaaagacttcaaatccagatgaagtgatggcagatggtgctgacacacaggagacaagcaaacacgaacaaaacgaaagcactaatgctgtagaaaacaccgaaaccagtcaagaaggtgcagttgaaacttcagaaaagcctgaggaaaagcccaagaagcaatcgaagaaagcatccaagaaaaagggtaagaaggatgaaaaaaaggacactgatagtaaaacaaaagagccagaagtggaggaagaaaccgagtcccacttggctaattcggttgagaagttaaaggacgatttcgaaaacgtagctctttgatctcttaacaagactaatgtcccaaatcttcaatttcataccttccaaaatatattccacaattttctaagatggtgttattttctcaatataaatcggatattattaactagtagtaatggtaaaattatgtccaattagatgttctatatattctgtttatgtctttaccaaatgatatgctgtacagtagtttcagattcccattttatatcaaatctcttgaaaataatatacgtgatcaaattaattatcataaaccatgcacattcagacaagtgtcttttcgttccagtcaccttacctattggattaccccagaatggttcaggtgccattgtgatgaaaagcctccaaaatataaatggcaagatgtagtatcgaggttcaaacaagggagaaggaaccaccgtcataaatgtgcacataatcaaggcagtccacgaaatatgtgtcaattgaattggtaaatcgattgggtttttaatttcaataggcaatatagggtggaatatcatcgtgctaggtctcattacttcaaggtagacatacgcggagaaatgataaattggagccatcacacaatacttgaacaaactacttcttccgatcagttttttgaataggtaaaaggtgatatgacgattatcagctagaaggaatggatgtaccactgtgaagtaccgtattatcaacataatccccaataactccaatagatactttacagggttcatgacaaacctgatcaagtacgatagagtgacttgctttgaaaaccataccggtacgctaaagaaagcaataaacatcaagcaatagaaaaattgtacgatgtgcaatcctgcaacatggttacttttatcgcctaatgtaattgatcgattgtataataaaaatgcaaggaataaaccaaagttgatggcatagggaagtaccaaagatttgaagttttccagtgtatgaagcacaagcttcaaataattgttgaaattcaacgtattgaagtttttctcaatcatagcacgacgttccacaacaagaatcataattaaaacgttccatacaatattagtctgtctaaagaggcaactgatcaatccacacagggcgctcatccaaatgctagctgtttctccgaacggtaacaccaatgccaagttcaatgactcgacgatgaaaatggtagaccatatatccgtataatacaaaaagtaataactagccatcaaagggaaacacattaatgttacaggccagaaccccaatgcattgaataaatatagcgggcgtaataccacccaaggccatacaattacacccccaataagattcgtcaagcgtagcacagttaatgtagaccaattagttataaatctggtcgcatgatattgcagccatcccaacaaatataggcctggaggagtagtgattttcccattccaagagtaccattttcctctaagatatcttaacgtttggtcaacatggaacttctcatcaatgaacacataaggaagtccagtagtgttcaatgtatatgccaaataacagaatagtgcagttgcgatgggccaaattattacgttcgcataaatcccaaccactacttctctctccacatccctggaaaactccactaccacagcattcttctcttcagtttctgatacgctcattatggcagcgtcactcgggtatcgtttgctagctgttggacaagaatatttcccaactgtttctccatcttgtatttgtgatgatatcatactgagtttaaaggttttttcttcgtaacttgtataattcttttcacttttagatatcaacggaatcgctcagacagaggacagagagttcagtgtcaaataatcctgcactccactccagggtccatatatgcgatctaggatagtattatatggattgtcgagataaatgcttctttacttcctggttgtagctccattatggatgctaagcgggttagttcgggctgaagtgtggccatcgttttcggacgagatgatatatgcgatcagatcgcagagagacttgatgcagaacatctcaattgaccaagtaccattaccaggactggcattgaaaaattcgttgccaggttcgatcacttccaatgaaactgaatcgctaacgacaattttatcgctattacatcacggtattcaatcatttcgggttgatctaacgttcaattcctctgccggagaatggtttttggaaggtactaacataagattcgtcaaaatgttgaacacggtgaatttatttgtgatggctaccaatacaaacttggatgctaacattttgactattctactgcgctttgataacgatactttaagaaactccaatgccatcaaagaggctaattttacagcgatactagaagaagggttaagtcccggatatgtgtattctattgcagatcttgaacgtgatcgtgaattaaatcagacgttgagtattaacggatactctgatacgggttgggttggtttgagcagattcctattcgatgttaaaaagcgggtcgtatttgggttcttgaatggagctgagttgttctcagaagacgaccaagacaatttagtattccctccagaaacatttcattacgttacagccaacaatattacatgtcctttgaatactgtcgaagatatcatgagagtgtctcaaatacaatggagatttcttgaaggtaatttcagctacgaaaactaccttcattatctcgaatgtgggtactcattgatccttacgaatccgatcgacacgagaaatgatagttcccagggaacgtcgttacaaaggcatctttcaagtttactactatggtcatggaatgcaacagctccggatgataaactcgatgaaagtgaggacagcgatgattccgaatcaagctctacttcacaatacgtagcctaccgttgtggggcattcagctataacgactatgaagatttggatccatttaagataggtaactgctacagaaatttgccctatttatgtcgtttcagtgatagagcttacttttggaacatatcagaagatactggaacctatttcgaatcggacgataaggacatgtgccccacaggatacaagtttggagtaccgaggacacctttgcaacaaagatcattacgaatacacttaaatgatatggacattgataacttagatttttggatcgatattaattcgatctctgtgagcaattgttggattacaggtggtccgtatgcttcttgtccttatcaaaaatacggttctcgaagaaattatattgccatgactgttcctacttcagcgatagcattggtattacttcttgtcattttttacttcaattgggttcacgttcccattcaggacaataggaacaactggaaaagaatcattaacgcatattcaaaggaagaggtcgaaggtgttccatcttgaaaggtttgaatttctgaaatactctaaattaaacaacgtacaactatataagctacaccaaaactagctattctaaccgctcagcggtacgatggtatcctagccggattagcatacctgataactttacgtattaaccttttcctcttaaattgatcatctaccagataatccccttctattctcgtcatttctaatcctctctcagtggcccattgttccacgttggtgtcggtagtccattcggagtttgagtcaaacgtccatgtcggaggtggctttaagtcgtccatactgtgcgctcctggcggtggtttttgagattttctatacggatcagatttgtcaaagacctgtgtggagtacatatagggtgaccattcttgctccgtgataccttgcatttggatctcaaatacctctacccaccttgtctccacaggttcatccaatagaatgtcataacgttccgttctcctgagagcttctttccccttatccagttgttctttcttcaacaatccaaatactgtaggacgaactcggggatgtatgatggtcataatagaccatgccagcaagctcgccatgagaccccaattaataaacggagttattatccacaataagaataagaccacaaaacaggagaggaaaacaactgttgaatattgctcattcttgaaacctgcagtaccgtacatgaacttttccatcttatcaataacagacactaacgtgctcattaaattctgtaaatctcttaaattgacgacgaactccatactttgacgtaccgtatttgcctttcgcaaatcattgatatcaatatcttcgtaattaaactcatgaatagaatcgcgcaactgtagcttagacgtattacctccagtggtgatacttttgataagggatttaccatacgatctcttggaaaggtagatgcctctatgtaacggatgtctatgcaagtatccaggaatcattaagccaaacataaggtacagtataggtaatattacaagaagcattggattaaaacaaatttgggtaaatgcaatcaatgcaaggagtgttccagaaggatttctccaagttaacaatcttatcaatatatcctgcagttcgaatattgcgcccaatctcgaggttaaagctcgaacattcttattcataattgtgacactcacagtttgtgagtgtctgcgtcctggttcagcaactctttggctgaactgttccctctctggaagttcatcaggaaggatgcttaatatgagcctgtcaatgaccatatcaatgaaatgttcccttgtttcttcaacggtatcctttgcttgctttctcagagacgtcttgacattcggtttctcccgctcctcttcagaagaagcggatctgatctcatactcctgtctaaaattctcatccttccagaaactatcattactctcgagatctgtttcgttgttgatatactcttgaaaatcatcgtcaattgtcttcgtatcatcttctctcatcgtcttgaacctttcccaggtagcatcaaataaagaggtcgctattccttgcaccaagtccttattcgatagcaacttttccctgtcccctggaggaacagcattgtctatcgatgcaaatacattctcgtacttcttcacaagatagtttcctaacaaagatcttttgctgacacgttttgcatcgtgtccgaattccatgaccagtactttcagcttctgatcttaatgtttcctgtccctaaaacttgcatccgtttatctgagtaatagctagtataaggcaagatgccatctttttgacgttttttgacatttgaacctttaaaatcgatgttgagaaaagcacaatgacacaatacacctacgacaagcagtaattgtacagggtatagttgctgttgtgaaccaagcgtttgagaggctggcttacagaactgtccggatcagtgtttcttcttgatacttatcgttaaactgagttttgggggatcgtatgtacaataacatcattagtttattaaattattattttatattatagttatttcaaagcagacattgtaaaagccacggaggcgaagaggaaattgggacgctatctaagcatgcagtttaagcttattccttcttcatgctcaatgatctctgaaccgtatatgccgttagacggagtttctctcatatcttcgcatgtattctcccaaatagaataaaatctgacagtctcatcatctgaagctacacaaatctttttagcatcaggtgaagttgctgcagtcaatgcacgtaattgggttggttgtttgattcgtattatctcttccatggagggatagctgtacattatgatgaaaactggaagttcttgattggtgaatccgaatgtcaccaatagttgtttttgtcctttggaccatattatggacgttatttggcctggtgtcttgaattctctgagcaatgttccgcttttcgaatgccaaaaccttagatgtctatcgtaacttcctcctccggtaacaaataacgctttcgaccaaggacaaaaggccatagctttcacagcagaggcgtgctttaatttaaactgtaattcaggttcctcatcgagatcattttcgttatatttgcatatggtacaacaattgtcattgcctcctaaggctatttgattagtttcttcacaaattttgataccacatatttgttgtgaatgtacgtgtaaagaccacgattctcctattttatgggtttgtatcactttctcagagttcagttccgctgaagttccattgatcttggctcgcaaagtatctgttcgcctcaatgatcgtgcaatgactataagttcggtcttgatattaaacttgtatacgacaccaacttctgtacctacaataaattgattcccatctttgaaccattggcagcagcatattccactatgacatttcactgtaatttcaatcaaaggctttggaggtccgctgcctatgttgttctccacactttcctgactaaatatgaagatcttgccccgcttggttccgacgagtaaaaaatctttggagctaaaggaaatgcattgaacagtgtctgaggtcttttcaagataatctcttctgagaacgtggatggcacctacttgatctgaccatagaaatacagccgtatcaagggcaacagcgacattattagtggcatgagaccaatccacaagattggaataaaaatctttccgcaaatgtggggcctcaaggactctaaatgggacccttgattctgctctcttgctgattctctgtttctcaacatctttgttattgagccatgacgataactgagcgtttgcatatttcagcgcttctggtggtggtagaattgaaattaatggatccacagataacgatggaatagtcaacgatggtatcatgtgagaaaattggagaaccctattgtaatctgggaaccctagtgcatcagccatatatttcctatgctgtttggtatgcctggatacttttttcttactcttcttctcacctgaatctaggatagaagatatttcttgtgtcaataaggtgttcacgggcaagtcatggcccatgaagaattcaggagatgggcttctggattgcaacagcggatcaaccaattgttcaagactagtcagaaaattttgcaattgtgaagacgagtaataactctttttggatgtggttttaggaataaaccgatcgttcccattgccgccaatatttttagtagaactgaacgacagtttaggtttatgtgacaaagaacccagaaaattcacaccaaaatcgtccctgagtttagtttcacgggtcttgtttatcattggagcaacaaatcaatggaaggcacccaatttacctctctgtgttgtctctttttgttttcttttaaatgtggtttgtttaagctttaatcctttaaactcgatgattttaaagataagtagcgacagaataatgatgaaagcagaaatgttatagatagcaatagcgattttatgaaacggatggtcgtaccacggtacgttcaaatagctcgaaagagaccgtgatagtgtaagccagtagaggatctgaacagatccggtgtctttagctgggacaatcaaaagaatgtgtcaaaaaactcattacatagatttgcatatgtagtctatgacagcgcactgtgtcacaaggtttatatacttgtgacatctttcggatgagatgcgtacaaaagtcttgccttggcattgtgtacagagaagtattgcgaagacggttcggtagcgaagagtaatgttttgtgggtatttatgtcaggatgacgcagttcatgtagatgaagtacattcatgcatctgtttctgtactgaagcaagtgggttggagtgcagctagtattaggttcggagaagtaaaggaatttagtgtcctcttttatggatttaattggcttgtggtataaactttaaccttaaatacctttaatcgagaaataaagatcaattttgaacaaaaccaatgtgatatggcagtatatattatttgactgtcagttgtggtccatgccatgatttgcgccatataggctgatatatatttgaataaaggggctatatccttctgggaattatctcctgtttcgtcctttcaacagtttttgtttatatatttgatctcatctcgatttccctttaaaataaaccaccagaacagttaattcaaactaaaacaatacaaaggacagctctttaacaactccacagtgcctgaaaaccatatacactgcattagggaagttactatgttgactagaaaccctattgtccccgaaaatcatgtttctaatccgattgtggattatgaattcaaccaagatcaatcatgcctcatagtatcgacaccaaaaagcttcgatatatacaacgtacatccgttgaaacgtatcatgagtcaagagatgcccgatgctggtaccatcagaatgttgcatcgcacaaactacattgcatttgttagtacaaagaaagagttacttcatatttgggatgacgttaagaaacaagatatcacaagagttaagctcgatgctgctgttaaggacttgtttctttcaagggagtttatagtagtatcacagggcgatgtgatatccattttcaagtttggtaacccctggaataagattactgaagacattaagttcggaggagtgtgcgagtttgccaatggattgttggtgtactccaatgagttcaatctgggtcagatccacgtaactagattgcagaccgatgcagagcaggttgttggaaaaggtgtcctagtgaaggcccatgccaatccagtgaaaatggtaagattaaataggaaaggagacatggttgccacttgttcgcaggatggaacgctaattagagttttccaaacggacaatggagtcttggttcgagagtttagaagaggactggacagaactagtattatagatatgcgttggtcaccagatggatcaaaattagctgttgtcagtgacaaatggacgttacacgtttttgaagtgttcaatgacgccgagaacaagagacacgtacttaaggattggatcaatataaagtacttccaaagcgagtggagcatttgcaattttaaattgaaggtcagtaaaggatccaatgactgcaaaatcgcatggatatcagatacaggtctcgttatagtatggcccaatagaaggttggcagatacttttaaattgaactacaacgatgacgagcatgtatggtggctccaactaaaccaaagaaacgaaatacccttataaaagaagaattaagtttcttgccatttcttactatttacaaaacggatatacatacgtaagatagcgtgtagttaatgcgattattgagtccttcaaagcttttctattagtaatctattatcttccactaacgccccatggaaattgtttctgaacagacatgcatctctaacattattgaaatgaatgaacgttaacctggtattcctttcatagttcacaaagacttggaagctgtgatgtatatcgtaccaccaaaactttctaaagacggtgaggtggtcccagttttctggtaaattccagactaaaagcgatctatgttctattgtctgtagacgtgaccagttcacggacaaatctttaggtacaggattcttaacttcatcaaaataagctttccctgatttactggcattaaccaagtttctatagtatctagcataatcttgctgcaaggaatccacgtctgttgccttgaatttaacggctctgtcatctaaaagactcaaccgcgatgccatcaaatattctttcattatatgattagtcgggaatctcaatatataacgatcgagaaacgtgaagaacttgggatctctatacttgaacacgtcaaaagagttcatcaatacctttgattttgccttatcactgatcatcgataccaacgattgaaaatcatcttttgtaagagacggattgtacgtcctataaacgaggaactttgtatccggagcgagccgttgtacatctggtttcacaggcgctggattgttcttaacagtggcgaagacctccttcatgagttgggacttagtcgtgccattcttccaaagtacttgcgcagccctcattatacgtaattaaaaaacggcagtttcgacgccagataacacctccaccgccggtactattaaatcagaaagagcgattcaaatactgctaccagtgggctatagaagcagctttcccttgatcaattgtagctcttcttcaaggaaagttgtagatgaatcgatgttaagagttgcattcggcgtatccgggtaactatgagatcattcctttcaataccccccaatgcagctaatattgggagaccgcatgccatatctctgcattaccatatcttttgttcacccgtgctgatctcgtcaactagccatactcaaccaggatgatgtcctactaccacctctttatttgtcctgttgtaccttattccctatgttaaatcatcaacagttaagaattttccatacgaaatcagaactttctcttctgttaactacttttcagaagacgctttcaagaagagaaaaaggtttcaaaacctcatagagattgacgtctggcgatcagtatcaatgggggcgttccagctttttactggtttgccctcgtttcgaacatggttcttgccttttaccagaaccatccgggtactgtcccaactatggactcaatactctgtctaatttttggcagcctttttttaaagaaaattttaccaatggtatcaccattggtaatcaaccttatcccatcttctcctacatctagttaatgcttcttttctagatagggtgtttgggctcttttcaggatcatgaatgtgagttagtgctagcacatattctttagatgactatgagacgaagactctcattgttcattcaatgctaaatatcaaaactatgtaaactgtagcatcggtgtttttcttccaagtaagacctgcaatgcacacaggccttggctaactggcgttcctgccgatatttcactaattgtggttttcgtgaattttttccgagatctctcgagctgcatttccagtaatttggaaattcgatttcttcagatctattgataactcttcgacaatcagaaaccgtgatttacaggtccaacatcaagtcccaagcattgatcccggggtagttctttgcgatatagtaccgagcatcacggtgtgtcttttttccctcttatttctggtgtttattggcctgggtttagaggcttcgttgaattagttttattttaacgtgttagtgaatcataaaagagacacgattagttaactgctctgctgatacccattgttttagtacaaaagccgttactgttcgtatttggattcgtttctgatccttccattcgttttcatactttatctgccaagaaatattatcatggctactagtaccactggatcttcttctacgtcgagttccacttcgacatcgacatccacttcgaaaagttcaaaatgtactggttcaagccagcattgtgaaaagccatctgattcgactaatactactgcagtggtagtagcggtcgtagttccggtagtagtggttggactggtattgatattcattttgtacaaagtatacaagagaaacaagaaggaagaactggaggacaatgatccagactttgatggtgacgcggaattcttaccggattttggacaagagtttgagatggaacgcaacgtcgatccttctgggatgagaataccctcatcagctactcgtgcattttcggtacaaccaaatcctttcaacgatgagaccaaatcgttcgcttattctcagagcgcaacaaatccattccaactgccaactgtgaccgatgattccgaaacgttaaggaattttgccaagactttccagaatagtgattttgatgggtacaaacttgcgacgcgttctgcttctcaaatatctatctcgagacccacgtcagcggcaggtgggtctgtccctaataatgggaacattcaactgtcgaatttgtcaaagttctccacagtttcgaatggtaataactctaacggtgatgataagattttgaagtacagtgaaattgtacaggattccggtagtcctgcagacgaggacgatgacgatgacgaagaggactcaaaggatagcgacctatacagtgagcctagccctgttaaatattccagaggaaacgtaacacaatcttatattcatcaagaccaagaagggttccaaccagaagtttcaatgcaggagtccgaacgcacatcagagggaattcaattacagaaaaagccgttcttggaaaatgaagatgatgtctacattcaacgtgatgaagaagactccgatgaagatgtggctagaatgaaatcgatatatcaggtttatttggatagaaacggtactgtgaaaaccattagagaaggaaatccggtgcccgaagggttccaaccggttgcagagttaccgaaggatgcatcaaacataattactgagagctccaactccaatgagcctacgaatccatccaatatacctgaaaattatcaagcccaaccgcaacatgagtattaccagaatggctattctcttcagccggaagccccacagtacccagaggaaaattatggtagaggtactcaagctgatggcaatacccaatcacaagatacagcagcgtttgaaaatcctaactcgaacgcaccaaaccaatattcagaccctgcgccaagggtagcgtcatcaatttatgacacccagtctcagtatcataatgaccatcaacaaaatcaatactactacaatcatcagtattacggacagaatcagtacgatggaagtttcccaacatatcacaaccaaatacagcataatctcccccctcctaatatggaaagcatcgaagagctcccacgaccatctaatttaccatttagcggttcctctcattcgttaacgtcatttaaatcaaaaaccacccttaagtcaccagcagcagcagctatgacaccacaaaataaccataactacaatccaatcgaccatccagaactttatttccaccaaacaaacggatcagatttgggattatcctcagatcaagcctccagcaatacaacaccatcacaaattaactctgcaggaagcaaggtattacctcatcatttgagacaatccgtggtgatgacaaatccaaacgagttgtctcaaaataaccttttcaagccagctggatcattctctcgtgctgtagcggattcaagatccaacagtttgatgtcaaatactaacacttatcaacaacagttacaagacacttatattaaatcgagagtaagcggtattcttgacgacaccgacgttatgcatccaccaagcatggggactattctaccgcactccggatcgcaagaagatctaagaaagcagttgggctcatcacacaattacaatgtcatgtaaagggagcattatttccctttgttttaccattctgtttttttagacctcttttggagtcttgttgaatacaatccttacgtgtttatatgcattatccggcatatccatatacattggaaccgagctcgaagcaaaagattgtaattagaatactttttcttatgatacatatataccactactacttactttcctttcaaatttgtaaaataatagtttttgccctttttcctacttccgaaggcaagtatagcaggatcaatctaggcatcgtcaaaatcatcgaccgcgtttctataacgtagtacagtcttcttgatcttggatgaatctgtccatgtaacgtaatcctccaaattccttgttaccaaatatgctggatctgtaatcaagttaggtcctactctaacatgaccttgttcaatgaattgaacggcatccttgagtgtctgtgccatctttaatctatgcattattacaggcaatctacgacgacagaaagccgagactgtaactttattctctagtgctgatatcttggattttgttgaaagaatgcccatatgatatagtttctctagcaagagctgctcgtgcttgatacggaagggatctgtaggttgtaaaagcgatagcttatgtgccaaacgacgcacatcaccacatattctgttatatttatgataatcctcacggttctggatatggtacgtacgcatcacctgcgtatctctgtggttctggtcctgtttccattcgtagaaatcgaccttcttgagaagcttctgctcatgatgtttcaatgctcttaccatactgtattacctagtgtatctgcttggagtatcctatccttatattggctatgagaccaccaaatgacttgctgaacgctcttgaaaccacttcagcctgctatatcattcagtaattgagatgagatgacgatgcgtaggcgatgagcttgaaatttttcaaaaagaaagggcaaagatcaacaagtcacgtgatgcacaggataatataagcacaaggtatttactcctgtgtttcgacgaagagcagtctccacatcccatttcgacccaggagtggcctagatggtcaccaatcgagagtaacagcctaagtatatcttatttaacaatcgtcaaagcaattaaagttaccctcccatactatctcactattaaaattttgattccaagtgaaaaattggttgaaagacgcatagagatgagtgctggaagaacagattgatatagacgcatttgatctaatatacccagtcatatagcggctgcaaagtgggctagactatttccaggatatacacaattaccatgacatttgtttccagaagactcttttctgtgtcggctcttctgcgctcacatattggttcttctccggtgtatttgacaccggagaccaagttggtggtggaatcaatgaaactgccaaagatcatcagaaagggtaacaaatctcttaagttatctcagaacgtaactgtatcgggtcctttggggaagattgatatggaaatcccagatttcgtggagataaagcaggatggatcttcgggaaaaatcgaagttgcagtgaaggattctaccgacaagacgcaaagatccatgtgggggacggtaagatctcatataaataatcatatcacaggcgtgaatgagagccatatggctgttctgaagttcgttggtaccggttacagagctcaattggaggaaaataacacctttgtcaacgtcaaagtcggtgcgtcggtaagacaaggcctacctatcccagagggaatcatagttaagtctccggtacccacgtcgttgatcgtggaaggtgtcaacaagcaacaagtgctactcttcgctgccaacttgagaaaattccatcctccagaaccatataagggtaaaggtatctacgttaacaatgaaactatcaagatcaaggataagaagatcaaatgatgacgatagaatgatgattataattattataatattaaataacatgtaaatacagaagcataaacatacacttccaataaccgtcaagggcacacttaatttgtgttaaatcagtgagagaactacgtgccgttttaatcacgtgatctataggtaactttatcgattcaaaaaattttcaatatcgaaacagctttaacaattatacagagatggaaacaggtttcaatagagtctttaaactacattttaaatcctttacagtttctccagcattgccaagaggttatctggattgacacatttgttatcaatcgaccagtctttgaaaattggggaataatggcatttattggcagtccttcgtcgaagatttggacaagacttttctcacaaagtggagtatcgaacggtgccaagttagtcgcaccatccgtggcaagcagcattcatctagatcctgtagatattaaacattctccagaaaatgcgctaaagagaagaagattacctctacgttgtggtgctttgagtaaaaaagtagggatgatgccgtatttcgagaaagagactggtaaacgtatagcagctactgtacttcagttggacaataacgaagttatactacacagaactccagctgaaaacaattactgggcttgccaaattggttatggtaacaagtcgccggagaatgttaccagacaaatgttgggacatttcgctgcacatgttgtgaatccaaaggaaaaagttaccgagtttagagtcaaggacgaatctggactactaccagtgggttctttaatcaaaccttcgtggttcaagcctggccaatacgttgatttaagatcaatcagcaaaggtaagggtttccaaggtgtaatgaaacgttatggattcaaaggtttgaaggcatcccacggtgtttccgtatctcacagatctggtggttcttacggtcaaaatcaaacacctggtcgtgtgttgcctgggaaaaagatgcctggtcatatgggtgtcgacactgtaacaattcaaaacgtgcaagtgctggacgtcaacgacgaaacaggtactgtcttggtgaagggctctgtcgcaggtccaaatggtgcattcgttaagatccaagatgctatcaaaaagccaaccccagtataaaaaactgtgattaagaaattgaatcttttcagtcgtttagacaccgtcccgaaatcatttggaaagcatgcctttctacggttattattaacaatctatacctgtatatacaccaattataaaatagtaactgctgcaacgttgagtgtccttttcaaccagatatttaatggctttcatacgttgatactggatcctgggtatatgtcggagagaattgattacaatttttttctctatgtgggaagatatacggcctgctatgtatatatttgccttgcttgacaagtgttagtttcagctttcattggatccgcagaaactttttcgtttcttgaccatgctgtacatttctgtaaggtgttatctttactcatcatcatccaattccgatggtttcaataacccaccgatcttggaagctctttctctttcaagtttatgttgttccgcgagagcttgttctttgtcctctgcgaacaaataatcggttggatctccaccgaactccttgatctggaccaagaaatctctaatagtaccagtgaaatgctttggatcatgatattgtttgagtagcgcttgaatgaagttcataacctgttcaccactcaaatgagggaatgcattgcttaacatggttgctagatagttagccaagtaagcttgattagaagtgactgcaggagcttcatcttccttgtataatggtacagctattctattttcttctactctggcaatcaaattcattaaaagatgagcttgcttgctgaatccagatttgtgatctgaatcagtgaggacatagaaggtttcgctaaggaatgtgaagtaatagttcttgtagaaatcgttagagaattcagacggactagcggaatcaacgttttgaataaggtctaaagcaatttgtaacccatttacctcaacatctctgttgttgtgtttgaacgcccaacatatggcatcaacgaaaagtttgaaagccggtggtggtagttgagatatcgctacgaaacacttggagttgatggccctcaataatttataaaactccacacgatgttccggatattccgtgaaatctttattgatcatgtctaatgtagcttcaaagacactctgtaaaatcaaaatgacaccgctgatcatcataggcccaactttgttgacaagtgtggtcatacaacttaaaatctcagcgtcacgggcatctggtacggtaatgtagtaatcccgtaacacagagtcaaacagtgctgatgccaagtcatttacgatgtagtctaaatcctttgcactggaaatgtataattccattaattttagaatttctttcttgattgttcttaaacctcttacctttggagtcttagtagcaataatcccatcgctggctacttgtgttgaaatacatctagacacagctgagcacaatgacatcattggtgtgaagttacgactcaactgcggagcaaagtcattacccatagcggaacaaacggcaacgtttgtctttagaatattggtaacgattttcacagtttcagggtccgacaaaatatccagatgagtagatgattgctgaattatagcgtcccatgccatgttagggagttgcatcaaatctgctagtaatctttgtttttctcctgggtttctttcatcagaaataattaaaccgcaagccttgtaaaatgtgtgtacttgctgaggttgaagatcggaggtgtggtcttgaatgtttctaattattgcctggatgaaaggttcactttcgtttggctgttgaacgacaaagtgacgtttacatctctgtacaatcttgatgaaggtgtcacaggccatatcttgaacaccctcatgggtttcatgcataaattcaaatagttttagaatgactgtcttcaagaacttccaatgagcttttaagaaacgtgggtactgaccgacaacgtacataatgttcgatgcaacaacagccttgttgtccttaccgcgctttttatcagtcaaggctaaaagatctttaatgattgtaacgacaaattttttctcagtttcctcgtccatagtaccagaaatagaaccaatagcccaacacaatgtgttgatgttgtgccatgaccattcagagccatcaagttgctttgccaatttattcaacatgatgtcttcagtatcaagaacatctaaatgcgtcaagtaaacaagtacttccctttcggacttatataactgaattgtgtccgactccttaacaaactctctgacgatttcaccttcatcgttttccacaataagaacttcctctggtctaaccatcgattctattataacccatcttaactgagaacagatgttatcgtaaatgtgtttctttaacgggaaccttttcaagaattccgggtgaggagcaccattgctccctgagaacatattcgatccttgagatagtttcaataggacgttattctgattttgagggatttgttgcacctcttggtacaaggccgaaaccaaattattccagtagtccaaagtcgttttgaacaattctctttcgtcaatcttcgaaagttcaatcaaatattgatgcgcagtaattaatagttccctcaaggattcatcatcttctaatattgaacggtgtctggccaaataggtagtcaagaacatggcaaaatcttgcaaaaatgattgatcgttgccattagcagtagcatatgtgttcttcaagtcagcattcaccggtataacgttaacagcaatttgttgcaaagcattttggaaaaacattacagttaacgaagcaatctttgggtcatttgctggaatatcaagttgagaaacttcagtcaaacatttcaaagtaatagctctggtgtcagcagagactaaaaatttcgtactcaacaattgcaaaatatcagtgttgtagatgtaacggtatgggatccaatgcaagtatctcaaaagagattgcaaagtggccaccataagggatggagaagatgcggtttccaaaatttcgtaacatagattgaaaatctgttcaaattgttgatccatagattgttttaaatgtagtgctttagcttgcgtcatttgctctgcagagaaatcaaagacttcctcacttaataactttagcattaccatgttgttttcacatacgtttacactagcttgggaactgagaaccaactccgggatgaagtctggccagttttctggccagtcctgcttaagaatttgaaccaaggttaaatcagacttatgaatcaaattcttctgagtttggaaaacctgatcatcttgacacattgaaataatcattccaacgatgaaattacgaattccaagtctatgctcctgaggtaacatcttccatttcgtcgtaattaacttatccaaaatggaaagcccaatgaacttcgtttgcggattatttgaatactgcaagattttatcagccctttgccaagcatctggatggtccttcaatttagtaagaacctcttgtgcctccttttgagacgcaccagagcccttgaaaaaggtatccaccacttgatctaggagctggatgtctaagtcccgagaaaagtctaaaacagcctccatattgatttagaaagaagaacgtgtgtgtggatctctttttactattttcctatgagtacagtgcagtagtatccttcttatgaaaagaccctgattaattaaatgcaatgtcttgttcctttagtctgctgtataaattccaccaagattcgaattcacagctgcaatttccgaaataaataataaagaaagaaaaaaaaatacaccggactatagttttcttatttagcactgaacagtaacggttgaatctagtacgaacaaaagtgactcgatagcacgctgccagatctaaaatttatctaacaaatacatgttaacattctgtttactttagaccccaaaccctatcaattgaaggttttggctttagtaaaactgcttctttcgaaaaatcaataatggtagggtaactaaattcgtgccttgtgatggctttaggcgtggcgcccaaacatacacgtgatctgaaatcttttcctttagttaatcaaaaaaggtactcttctgtgggtatacaagtctatatatgtaacaaatgatggaacataaattaagattaggtactcattgatctaagatgatgatgaggatgagtcggttgttcctggtttggtagatgtgtctttgatcagagttcgagatgtattttcttttgagctactttcatcttcttcaaaccagtgattgttgcgacggcctggcgaccacataaactctgattcctgggtatttaaaacaggtgacttaaactcaagctcgaaatcttcagtggatccgtttggataagaggatattggcaccattattttaggtagttgtatcttgcctctacggttcagtaaaaatttccatcttgcgacaaccattagcatggtatcgtagtttctctcgttccggatcagtttatcaactttgttcatgtcgtataaatttttcacataatcatcgatcccaagacattcagtcttgttatatgtagtgtacaatggaactgtttccatcagctgattgaactgcacggcgttgtatctcttatttcccagctgaatttcatggacaaatctgttataatctagtcgtctggcgttcactttttgatagtctatagaggaaagttctttgctgagtccgaagtgatcaatttcaacatcatatggatcgtttgggtttactttcatgtatttagacaccaaactcttaacagtaagtcttccctcccaaattttaaacgagaggggtccatcaaacgagtgcatgaattttggtaagtacgcgacatcaaattgccctacaccatcaggatcaatttccctccatgccactttgaatttcctcacttcttcttggcttgctggtgagtgcttattttcctctctatgatagacgtagctgaacttttctacgattaaggaaacgaacatattaacgaaaatgtacatggaaattatattccaggacattagtaaagcatacgcgaaagcttttgaaccacaatcagtatagcttccatcagcttcagagtaacaaaatggttcttctattgtcaaatcattcatgatatagttccaaccttcaccgaaactgcatctaaacaataaaatcaaagatttcgtcaccgttctacaattaatgttccccgtggtattaggacctaattttgttactccaaatacttgatttaaggcaatagcatacacaaggaacaaaatgaaccatgtataaaccaatgagaaaatagatggtaaactcgcagtagctgtgttcattaattcattcaaagtatcattctgaggaatcactaaaaggaagattcccaactggaaaacatcacgcgcattggaaatacccaccacgacatgatcgacaatgagttcatatatattagttgcaaatgcaaacatcacaacgacacaacgaaatatattccaacgttttcttgcatatagccgcattgatttcccgtatatatgcatgacttcttgaatgagtaaaaatgatgtggtaaccataaattgaatattttgattcgttggcagtttcccataaggttgatccttggacattaaaagtgttaaaatatgcaaatacaacatgaactgcatcaagactgagaagtagaaatttcgcttctccactgcccacaagtaacaaattctcctgactgcattcatcttgaaaacgtttggcatcggatcagggcacacttgtgacagcaatctctttacttcgagccatgatttctctgccagagttaaatatgccgtacctttcattcttgcattgtttcctacaataaatgaaacaaagatattcaagatgaaaaccatgctgaggaaattgaataaaatcaagaagattccactatatggcgatgcaaataactctgcgggagttcctacaccagtgctactcatcatattttgcaataagtctgtccaaccttcaagagatacaatttcgtacatcgatctaaaagcacttgagaacgaattgaggtgcaatatgggatcagcatatgtacggggcattaaaatgtcccagtggaacacttgatttgtgaattcattgtagcattctccataggacaaatcaccatcattgcagaccccaagtctaccacggaatacattaagaccccatactgtatatggaaacaaaatactaaacgcaactgcgcaggcaccaaaaatatacgtcaggccatcaaacatgacctgtttgaaggtcattcttgccatactactaattgtcaaaaatctaagtgctcttaaagcactgacagctttgataattcttgccaattccccgtttcctaataaccacgcaaaaaaatcgatccatagtgcaattaatacgactaaatctatcctgttccaaggattcaggcaataagcgttaggtgtgtaaatgaacccatctgcaatagtttttaccaaaaattctattgtgaacaatggaacaaagaccggttcaaaataagtagtccaattccattttttgttgtgattcatgcgatataacggtgtaacatagcatgaataaataaccatcaacaaggtagcaacaaacgtcacaaacacaaaaatgtctttctcaatattatagaagaatctcttttgaccgactttattggtagtatcatcaaaaaaaactctattgttagtcctcttcccgtaactaggaggtacaagtctttggcaaaatcgtctaagagcatgatttggtggaaatatgaagtacgtgttattgaagttcggatgctgcttcaaaaatctaagcttttcctcttcccaatcgttcagtttcaatgtgtatttcctgttcgatggggttgtatcatcagactgaacaaaaaccaccttcggatctttaaaaaaaggattcgttttgtaaaagttaagtgcctttaatctccatagaattctgttccaaaatgacgatttgacgttcctatcggcaaactgatgatccttatcttctgaaagatccatattgaatccttcgtaattctgagcaatactcagaatagcagtacctctgaataaaaattgcctgaagtcctcagaatcatcaatttgcggtttacgcaaaaattttcttctgatacgctcaagcaaaggtaccacggaaaactctctgattctttccggataagtgacctttaagtaatgtttaatttgcagcaaacgtttatcctcttcttcaatatcaaaacttgccgctattacagcaacgaatacgttaagaacaacaaaatttgagagaatgaaccatagaataagtagaactgaaccaaacaatgccgaaaataaagtaggagaatctctttggagtgcgtaaagtgaatctgtccaattttcagttgatgcgattttaataagggtcagaaaggcgttaggtaaagagtagaatccaaatggagtgtcttccatatcatcggcatctagagttccatcgaagtatagcaacacgattaatgatgccaagaacacgaataggaagtaaaaggcagataaattccatataactattgcgtttttcaatacctttttccataaatttctcgtcacactgaacagtatgacaactctatagaatcttgaaattgggaagaacaatagccatgcagaagtctgtcccaaagatatacgcaagctattgaacgaaagaacagcgcaaatgattgaaataataaaatcataaacataattaggcttcgctaaaaatttccatggagttttacagtataaaattagccgtaatattgtttcaaccacaagaatacaagaaacgatttggttaacgctgaatatatcctgagctgattgatcggaactgtgactcttcattgaagcaagtgcacaaatactggtaaaaattgcaagaacaaaaaaccattccaatttttcgtaaagcctaattcctcgttctgcccatgcaggtgattttgttgtgtctgatttacttttgattagatgtgccaatcttttcacattaaacacaaggtaattatcttgagtggaaaatttatctatggtatacttctcatgaacaacttcaaaggacgaataaaggacagcaattaaaaggttgaccatccagaccgtgagacatagtatgctaacaataaaaaataagcaggctgccatattatctgtatccatcgtgaagtacattagatcagtaaaggtattagcactcattatcacgaaaactaattccatagaattaacaatattgtcaaagctgattcttccattgtacggatttgcattcgaaatgcacttggagttggctggacacaagaatcccttagctaatggtccttcactattatccgcaaacacatacttcattggctcaagtgtttccgcatttaaatatcctccacaaaactgcatgtcatactgataataatcagatggatcatttggattgaaccacacgcactgcctcttcaaagatcctttgaatgtttgcacacctagaattccaaagaaaacccagaaatatagaagcataaaaccgacatttagaagttctggtattccgtatttcaaggctcttaagatagaaactaaaccagagtccaaatccacaagtttgagaattctgaatgccattaaagacctgaataatctcaacccgtgtacatcatcataatcgttaatacttaagccatatgcaagccaagcagaaatcgtcgacaacaattcaagtcttccccaactacttctagtaaatgctctaggtatatcgacgggagatttaacatttctaaagtctgcaacagtgacagaacttttgagagccgctgactttttttcgtctatggtttcttggaatagtgctctgattggtataatgctgtgaataaattttgaagagtaatgagtctccaagaatctataaaatttccttattccagttacatcccaaaatgaaacatagttctttcctattgcattcattaaatcagaatcgttccagaatccaaaagcaatgaccttggcaatgagttcaaaagtgaagaagctgttgaatatcaaagtggcaacgtaagaaaaaactgacgatggagcactgaaatccttttcgcctgatgctgtgctgccgaaaaatacactatgggctagaaatatagtatagagagttaggacaagcatagagaaagctttgtaccatgttttcagaagaattgaggcacatttcaatctccaacggttgtctggtgaaataaaccctaaggatttcccgtacaattgaagatgcctctctatagttctatctattccgggatcgtcatcttcttcatcattaatagtattgtcatacgtatctgtcggagcagaacctacgtcgtcatgatttcgagtgtgatttgaatgaatcgaaccagtcgatgtctgataggatgaatgataaccgaaagcattcactgagggtgtatcagttccaataggaatactttgaagttcataatcatcagtaaatagatcagagctatgatccctggcaacaggagcggtttcgtggatggatgaccttcttgatccacgtgtgcttcgacttctttctgagtggccgtctgatgtaggtttccgtaaccattgggaagtgtccccacctagaatgttcttcacatcgtcttgtaaatgtttgaaatcttgtaaatcatcgtcagtaatagatagcatgtttgaaccaccacttatcgaattagcatttaataagctatcagttgatggatcttggttaaatgatcgtaacgattcttcttctattataagcccttttttgtcatcgtcgtcatctgcagcggaaaatgtcataaccggcggttgcaaacgcgatattcgatctaaattcggtgcattagcctcatcagatgcagtatctgagtttattggtaggtcaaggaaggatgcaccaacagaattccttctggacctcgatcgagaacgagaacttcccccctccattaaaataaaattaatacaaccgtcgagtaatgaagaaagctacaggatgaacttacgtttataaccaacgtgatactcgaacttgaggctatatcaggaattcaagactggcgttgggcactctgtgtttcttcttttgtaatcatctctcgtgataccagcttcagaatatcattaaagtttaaatatccatgtcaataattagaaacaaactagatcaaagctttcagctgaaatagcaagctgtggaatgaattacgaagtacggtaatcacataccttaaaatagttatatagcaggtgcagtgaaactgcaaggacgttcatggatcgacggacttatgtatattggcctgcaggactcttacggcaatgcaaatcggccgatgagcccttagtggtgatagttttgaagacctcaagttcagatcctttagtcatcgctgtcatagaggcgtcaaagtacaggcctgtggaaaagccttatagcgagtttgggaggatttactcgggaaatgtcaactcaattgaaacagctgagcaatggagagctgaatatacaactatttgtttcgatccacctaaggtaaaaatgatgcaattttactcgttagagccgatatcactaatattacagaacccattcgaagatttcggtgtagaaacaacagataatagcgctattcatgatggtacatcggtttttaacatcagaaagaagtgggaatcgagattgcgggagaatatcgatcatctcaatttatactatcaacatctcgaagtgttctataagagatatgcaatatacaagaacaaatcaacgttgaatatttcgataacagatttgaaattgcggatgcgtgcaacttctgtttacagaggtattagatgtttagctttttatggtgccgccttgataagaattgttgcaggatttgtgtcgtatgttttaaattggagggtattgccattggtaaagttattcgcaactgctcagcagattgaccttagatgccagcaactttgttatattccagtacaatatctaaggattaataaaaatgtcaaattgactgatctagaccttcgaacagatgaaaatggtagcatagatgaaaatgataagagttcgggtttcactaaacgtcgtaaaagccaccttgtgctaccgaaagcacttccctgcgaaacctatcctgattatattcgactttacaatactctttggctcatcataaacgatgtttcgtttggtgccacactaggaactgtgttatatgaaaaccgtattacattggcccaaaatatcagtacaactttaaagtatttactttatgagcttcccatgcaggtgacgttgattttagaacaaaacccactgggtatcaaacttaatgatgagctttccaggtttttaagctctctttttttgttaatcatcgaattcacttataccggatggattcgctcgtgcattgaaccagaaactatacgacagggaataacagtaatgtctcatatcagtgctgtcatagggttcactttcactttggccctggctgttgacttcctgtggatcatgacgctgcatatctcattattttacatgattagtgtcaaactttatcatgttcatatctatgtgttgaagagtttattctacctgttttatgggaagaagcaaaatgtgttacgtagaagagttgatgatatgtacttcgaattagatcagctattgatgggaactttaatattcacggtgttaatcttcttgttgccaacgttattttcattctatttggtatacacagtgttcagatttgttgaccttacagtgaaagtgttgcttgaactaagtttggcccttatcaaccatttccctttatttgcattgcttttacggataaaagatgctaaaaggttacctggtggtatcaagttcaaagtatatgatgatcacttattaatatcgaataatccaatcagctttttcatgacctttgaaccattcacaaacgtcatgaaatccattcaaagacagatgttctcggttgagactttgaagatggtgagtcagggatcagttcttaatgtacgaagagatgaactctatcgtgttttgtaccataatctaccgagacatccaattgatatcgatttactatggaaaaagttaaagatggtaatggaacaagatacgatataaacccctctcacaaccacaattaatggcacagattgcatagtttgaatcttacttgaatattcgtatttaataaaaacatagttgaaattcgttaaattcttgggtctatttgaactgactgatataatttatatacaaggtatttttatatgatggaaatgttaattgcaagtccctttaagtgggataaaaggataggctgggctcattttgatcactttctcttcttggtctttttaccgtcaccagaggcctctctcttcttagttggagcacccttacctctacgctttcttagttcaagcatagtcaatctatattgttcttcttcatcaacgaagttcatgcctggatatagtttcttcaattgcttgaatctgataaaatctgggttaccataataattcgcaatagcaggtcctttaagcctctgtgctaggatcttagacccagttctggcatttgttggattgaaattttgatcaaaaactttggctgatatctcagcaagcttcagtagcctagatttgggtacagacatttctcaaaatatgaaaatatgagtgataactgatggaacaacccgcaaactagttcgctgagagttaaagcacacctaagacctatttattggtactttcacttactacttctgcagcaggtttctattttatgcaagctcagttttttttcgaatgttccaatgttcaaattttcattatcaggaaattatcaccatgatgaggataagagcgatgagagatgcgagaagggtcacattgccatactgggtactgaagcaccattgaaggggaaatattcagttggcacgttcaatcaattaaataatattcaattctttgtataattatcgggtactagcctggatcaataatgatattaaaattatacacgatgtggagttttaaaaactagtaaaaatagttaaaaatatgagcggatggttgagagttgttgcatgaagctataataataacaatgatagtatgctaagcattgaatctatattatagaatgatgaattaaacaaaaaaaaaggtggaataacttccaggaattcagttaaagaattcttgaagtttagttccattcttcttcttgagcttgaccttcttcagcccattcagcagcttcggtttgttcttcagtagcgtcaacggcttcttcagtttgttcaccggaagcaacagcttcttcttcagcagtttgttgttcgatttcttctgggtttctgtagaagtacaaatctggcatgatagcccatggttgagttctgtctggtagagcacctctcaatcttaggacttctctagccaacaagtaccagatcaaaccgatggagtgcttacctctgttgttacatgggatagcaacatcaacgtattcggatggggagtccaaatcggtcaaagcgatgactgggatgttaacgtaagaagattccttgatagcttgagcatcggatcttgggtcagtaacgataaccaatcttggttccttgaaagatctggtgatgtagttagtgaaagaacctggggtaaatctaccagcaattggagtagcaccggtgtgagcagcgtacttcaagacagctctttgaccataagttctggaagagatagcaacaacatcttctgggtttggaatggcagcaatgattctggcagccaaaacaatcttttcccaggtcttaccaacgttgataacgttgacaccatctggtctagccttgtagacgtatggttcttggtgaacctgttaataattaaaaaataaccatgcaaacgtttcgttcgcaaaagttaaaaatatattgttagtaaagagagagctttttcccaaccgcaacatgcgacaggatacacttttcgaagtgcagatattaccatatgatagaggagatgttcgtgtacttttttattattattttagttccctagaaatggcaggccatttcaattgttgttcttttaacagattcagttaaaaccatatcctctcgtacttcagtctgatatccttgttcgaagggaatcagaattgaaataacgaggggaaatagaatgtttaacgtacgtatatcctctatgctgttaggtaaagagcaacaaatataaatatttgcatattctttcttgtgagtgaagccattatccttgacatcagcactcatttagttagtagcaccgtgccaaatattcaacatccatgattaacctgcggagaggcctaaccaatgttattgatttaaaacacgagcaaaaacaaggtacaagcataagtacagaagtatcatgacagctaatcttgctgtgatacaatattctcttttttgtaacagttctttctaattgatgcatttctggtattgaacaaacaccactcctcttatcgaatacgtattatccaaaccgaagttcgtatccatatttcgtaaatttctcaacatacttggacgttcttagcacccaagtggactctggcagccaacaacaattgggcgtcttctgaggtcaagtcgaaggtagatggcaaagacattgtttgatatattcttgttctcttggagctatcaattgtgaatcgtaacctgtcctatctaacgtattattgttgatgagatgaacaagtatataatgatgcatgaaatattaaagtgagatattgtccaatgttccgatcttccaatgcatcaagcaagtgaaatttcagaggagcggttcgagttagaaaggactgaacctgccccatccctgcctaggaaaacactcgactaagcctagctcctgcgcggactccgcccttgctgtgcgtccgtccagccaatctccgttagcatccatctcgtttaaaaaatctggctcgtgaaagggaaaagacatcgattttataccacgtgctatttcctaatgtggaaaatatacatttcatccagtgttaaacttaatataactggtgtatgggtgtctgtgccacagtcctgtgcacgtgattatataccatccttttcatctcatttcatttgatatgttaccctaccagagcttcctgtcggccggaattcaaaattccgttacagccgatccttggcactgccagttattgtatgcctaatggccatcacttcgaccaagacaatgcacagcccgaatgcttggttcgttgatccgataaaaatctgattagtggctgctgtcagttgcttgccgttttagggcactatcacaccctgaaatctgatactaaagtgtatcgaaatattacgtaaaacagacattgcaaaaaggcatcgcatgcgatacctttacgcagtgtccttccatgattcaaatacacccataatatattatcttattgccaccacgctaatcacacgttcgtaaccacgttggtgctgcacccctcgtgccttgaatcagtgtgtgtgtgcatatttggtaagcttaaataagattttgaccttccgaatcttcaccttcgccatatataataatctttataacaaatgcatttgaaaatactggaaaatcacagccttattagagaacagaattgtactaagagaagaaggatattgaaccactgattctttggtgcatctatatggttgtgaaggtgccctcatatctatggaataagtccaattgaagttgttgttccgttgttttttttgtacgtgagaatgagaagctggttgtttgaattctgacactggcttgaatctcattcccctagttttgacgtgggaacagaaaaaccaataaggttgcggttggtacgacggtcggggcttgctgtgttgataatatcgatagttattatcttgttgttcataccgttgattaactatttgaaacttaggccatttttctttaaattggagcataggttaaggcatcatacttttaagagagtttcatggatccatagatccagaatataccataacgaagcattgcaaatcactgccttttggggtgtgataacgtttgcgtttgtgttatacgattgcaacaatgatcttgtacttattacgaaacgtttgggtaggattcctgtatcgttgatgccagcgcttttgtttttaacgacaaggccttcacctttgccgcatgttttatatctcgcattgctacccttgcataaatggatttcaagaattgttgtcttccagtcgcttctgcatactatactttatacggtttattacgccaggattggtgcacttgccaagttgaagaaattggctaacatttggggcatcttggctatgcttcttttcattatgattgctgtaacttcgttacctaggattagaagagtgaatttccaattattctattttgtacattatgcagctacttggctctctgttgtgatgttgcaataccatgctaggcctaatatgaatatgatttccacttttaatattatcctactcctaggacaaatcatttatcgattatggaacactaggttatcaactatttcagtgattccagtgtcacctgccattagtgtggttgagttcccattagcagatctttctaagaaacccatattgccctccggccatgtccgtatgaataactatcataatttttggttgaaacgttggttttatcacctaataccactccaacaccctttcacaattgcatcgttaccgaacgaatcgatggtcaggttaattgtaagaactgggaagttcccgttgaaaaccaactcaaaatactacatcactggtgcgttagaacccaaggtggatttcatgtcgaaaagtggttcaagggataataataggctacttccgttccaaagtgcaactccaatgttgttactctcgccactttctttcaacattaatgcaaaaagagtgtttatggttgtcggggggagtgctatctcctttggattgcccatgttacgtatcttaaactttaacggtgttactgttaaacttatttgggtcacaagagatcatcgagatatgaagattttaaacgtttttaagaataattataatggccttgagatcttcgtcactggtacattgggagctgaacaggatttgcagatcgattatgtagattatggaccggatccattaggccttccacatcctgaactgcaagaaccagtaccgcaggcacttccttcttcttcagattataacccagaaacgactttgacaagctccagctatcccaaatacggttccatttctacagataagtccgcattctcatctgatttagaccattcccagaagcacaatgaggatgagtttgattttaccaacgtttacagtgctacgaacactttgaagagaaagaaatctgagcccaagttatttggtccaccttcaccattccataaagatgaggcattccgtaaaccaaaggttattatcccacccaacgatgagaattataaaagtgatgtagaaagtctagaggatgatgatatgaaactgacaatcccagcaggagttaaattagtgtttggaagaccccaactttcaaatttggactatcagtggtgcttacagaaagaatgttcccttccatcggaagtcgacgactgttgtgttatgaactcggatgttaacataactcatgttgatgaccttgctaatgtgtgggttgtcgctgctggtcccaagggtttagtcgaaagtacaaagagatgggctaccgatggaggtttgcatttccatgaagaaagtttcagtgtttgatggaattttgaggttagttaagttattaatggatgtgatgcagtaaaattatatattaatgtttaagaaggtaaactaatgatggaagcctttcagcctatgatgtgtgtatacatactattacatatagttcatatcatcagaaccaaaatgcataaaatgagttgatgaatatgatgcgagtgaaacgccaaaaaatatggaaagcgtgagaagaaatgaaatcatgatagatgattgtttgaaaacggttttttaatcaaccttcatttcggttagacctaactcttcgttctgttctggagttctttcataatcttcgatagtcatatttggatctggatctggcgcataaacgttttggatatatgaaccagccaatggatcttccatgtgtacggtaaatttgaccttaccagctaaagcatcttgaagtcttccgaagaacgaaacccaacgttgcttggtaggttcatccatagaatcagaggtttgagtaaagacacgagattccaattcttcgtacacctgtcttaacaaaccttccaaagtggtaaatctaccacccaaagtaccttcttggatatctagacttaattcggggatgctcatcttacagttttcacccttcaagatatctcttgataaatcatctggttcatcacagtataaagtaatttttctacccttttctggaatagcaccacccgtcttaacttcgttcgatttgtaaccacaatggtcgcagatggatgacatgatgataacttctttgaaatgaggaatattcacacgtttcatatgagtatcgcattgttgcaaacagtttggacaagaagctctgaaagtctgaacttcgttagagaaattctcgatatcagtagcgtctgataggaatccctgggcggcagctccttcctttttggctacagaagggtttctttcacgttctgcttctattctctcacgttcttccttacgtctttcttctagttgatccctagtaatcaacccgatctgaacattttgttcatcggatctcgtatattcagcatgagaccacttatgagcagcttccccaggcttatattcgatccatgagttccctgttggatcatctataacgaaagttatgggcaaagtaccatctttgcatgcgattgtgtcctttactttgtcaataaatgcctggatctggtcgtataatggcttgtcgatcttctctcttaaaggctgatcactttccaaatcatccaccatttcacttagtagaccttctacagtagtgagctgtccacgtttccctgggatttcaagatctaattccacgaacttacagctagcagtctcagacttgatgacttgtctgttgaaatcgtccttctcttccactttcaacatgtatttagaacccttctcttggatctcagaagcaggctggatctcacaattcttgaaaccacagtgttcacaggcgaaagacataagaactacttctctaaagtaaggaatcctcgtcaacaataatctggtagtacccattttatgacagttcatacataaggatggaatttcctgtactggatgacccatagcatcaaaggcaccggtttgaactaacccagtatcatctgcctggttttctccgttttgagttgtaccctgttgcccctcattggcatgttcagcgtcttctacaatctcaccaactggtttaaataagtcttctggcatgttgttcaaaaagcgtgaattattaaatttagtctccaatatgggcaatttattgattctcacactcaaacctaacaaatgataaaatgtgacactttccactagtaaagcaacaaatgcaacaacgtgaattgaccttaaatgtacgatttcacaccgaagttgtgagatgaggcaagtttatatgctttaaaactggaaaattttccaaaacgtctagcttagtatagaaaaagaaagcttttagcctgaaatcttgacaaaaaatcagttttcactgtaaaagaagagatgagataggatttaaggaacgtttcgttccgttgtatggtggaagaaggtactggatggtgctagccttcgtgcggtttgggtctgagttgaaaccggaaagatatttgccttttgtcccgttgaattttgattcgtggaacggtttttcactggttaattcgagattgcactggaacattgaggaaggaacctaaaactgaactgatacaatatgcctcgtgatccgttgatcggtattgttggaaagccatctagtggtaaatctaccactctcaattctttgactgatgcttctgcgcaagtcggagcattcccctttactacaattgaaccgaatagagctactggatacttgcaagtgaactgtgcctgcagtagggtagggttgcaaaagttgtgtaaaccgaattatggatggtgtgagaacggtcttagacacattcctatcatgctcttggatgtggcagggcttgtgccaggtgcgcatagtggtcgaggtttaggaaataagtttttagatgatttgagacatgcagatgctttgattcatgttgtcgacgtgagtggaacgactgacgcggaggggaagaacacccgagggtacgatccattgcaggacattgtgtggttacaggatgaaattaggttgtggattgaggggaatttgcataagagatgggggtccatcgtccgaaaacatactgcgaccaagtccagtgctgtagatacgttgcagcagcagttcggtgggtacggttcacatgcgccaatgattcaaagagctttaggtagaattcctggcttaccacctttggaacaatgggataatgaatggatcactgaagttgttaagtcgttcatgcaagagaagttccccactgtgttggctttgaacaagatggatcatccagatgcggataaaaacgttagtaagattatgttgaaataccctgacgttaaatgtgtcctaacaagtgccatcaccgaagttttcctccgtaaattgaagaaacaagggttcatacgttacgaagaaggcacagaatttgttgatacgtttgaagatgacgatacgttaaaaccgttagatgagaaactgatacagagaattgaagttatacgagaccttgtactatacagattcggttctacaggtgtcgttcaagtattacaggcagctgcaagtactttaaatttgatcccggtgtacacggtacgcaacatccataccttcgctggtgggaacggtgaaaatgtgttccgcgattgttttctggtcaagaaggggactacggtagggaaagttgctacttacattatgggtgacgtcactgtagctgctattgaaactgttggtggtatcagggtcagtgaagatgataaggtggacgaaggtgttaacgatatcttgacattcaaacttgcaccaaagagtaagtaagtacaggaaaaccaaaaaaaatagtaatagaaacaataataaatagatacaatctattacggattacagcagcccagtattcttctgggatatagacctaaaacgtttaacaatagctaaaaataataatgaaagaattgcatactagtagttatattagaattgtaataaactcgaactaaattaaggttaatttttgaggcctgacctcaaaactactactggactttaccgagtcgttcgtagctgttataatgttggctttgattttttttcattttacaagcttattagtcgaagttaaaccatacttagtcattcttcgtcgtaatcatcataatcatcgtaaaagcatcatttcaaatgttgtggaatattaattgtgaaatggggagaggggatgggtagtcaaataataaaggttttaaaaggaaacaaaaattaaagtttttcgtatgagtttaggggagggatggtacatcttgtttgtttgtctctatctcactctataaagtgcacatgagtgtgggtgtagtcatttaatttaatgttttccttttttcctttttataatgctatggtgcgtgtgtgggcatgaaattgtataaaggtttagtttctgttaatcattaatcaaactgaaaccttttccaattgatcatcacttggcttagaagaaatagaattggccgtggaacctgtcatagcagcaacttcttccgtttggtcaactctttcgatataagatttcaaatgaggagaggataaatctctgtggaacttctcgtgaccgacaaataccaagacaaaagtgaagatgacactggaaccagtcaagatagccataactttagagtaatccttgtttgttacttcacctgcggagttccattcgattgggtacaaatcagccaaatcgttttcgataacgaccgaagcggcagaagccaagttacctaattgataggcaagaccagagaccaaagctctagcttctggaggagataattcggaaagatggattggaagaacaccccagacaccaagaatggagaaccaaagcatgaaccctgcacccaacacagcagaacttgtcttcaacatgaaagctggataagtgaaacaaccggccatgataagggccaagagcaaacctactcttctaccggtgatttccattagttgaccaaagaacataccaccagcgatggaacccaaacatacaacaacaatggcaacggtaacagcgtcttcagagaaacgcaattgagcacgtaacatggttgggaacaaatcttgagaggcatgggtcaagtagtttggaccaacaagcaagagaatcaagtaaccgaacaataaccagtatttagaaacagttttcttaacgttagcgaatttttgtttgaaagacaattttggcaatggttgaccaccgttcttggcaatggcatcgtctctcatcaattgtctagcctttaacaccttagtgaaatatttagtctcaggccaaaccaatctccataagatcaacacagctggtaaccagatagagaaccagaattgaaccttccagtagttttcaccgttaacgttcaagaaagctctgtaaaagatgatggcaaagatgaaacccatagcatatgcggtaaagaaaagacctgataggaaggatcttgccttcactggggcatcttcaatggcagtggcagaggcacaagcgtagataccacccatagcgataccagaaatccatctaacacccaagaactgagtgtaagtcttggcccatggggtacaaagttgacagattaagaataaacccaaacaagtgatgtaaggccattttctcgaatagttatcggtccagataccgaagatgatggcaccagcagatctaacgaaaagaaccaacgaaagaccccaagagatatccttagtttctttgccgtacaaagtagccaatggagccgtagaaacggacactgcaaagaacgcccaagcggcacataaccaagccgcataccccataaagaaatagttccagttgtgtaaagtcatctttctcaactctgggatcggattgatattttccatcgataccctatgaagctcggtcaaagtggtaaatctagtgatcgcatagtgacgaatgtttttccaagtgaaatctggggtttcgtcttcctccataagaatcgacacttcatcgtcctgccacacctcgttaccgttttcatcgacatatctgtcctttcttgacacatacgatgcaacacgtgacaaaactgaaccaggatgggaaatggctctagcaatctcattggtattggtttgcgtatggtcgaaatccgctacatccggcatataatcgtttgtttgatcattatcattagatttcatagagtcagactctggtgtaatattgttgttattcatggttgaaatctgttttggttttggttactccagatcatacaagacatacattacaataataataagacacaaccacaacaagattggaagaacgttgattgtcgaaaaaaagacgccaaaccagttacttttatatatcaagaaacgcaggtgtggtacatccagcgggctcatactgaattagagttattttagtgagagatagtaaaaaggtaccggagatgaggttagtgaaaaaaaaaaaaaaaagtttcacagatcatcacaataactaaatcaaaaccactacctggataaccggaacactggaaaatactcgcccctcgtcactcaacagagaagaactggagagcgtttcaggaaggaaggaaagaaggaaagaaaccagatggaatagccaaagtaaccggcacagaagcatgacgtttaaggtaagtgtttgagagagtatcatcatctcagttacggaatttggatatatccgcctatccagtcgccaattcgcagggacaataagcaaatgccccatatctaaaagtagcttaaaagtcgcatagaggaggcaaaagggcatgaagaacccttcgtaaggttggcggatgcagcatgtggtagaagcaaacgggtattgccattatcctatctccggaaattcgctgtaattaggcaagtccgttgctccagaggaggaaacacaccccagactccgagaatcgcaggatgtgtggtttatcgagttgtttgatggtcagaagtactggagagaagagaagagagattgttgttccacgcttcgaggagggaaaatcttttcttttccttccagggttctgcgggcagtgtgtggagaacggctaatatttagccgtttcggcacgtatagtgtaggttgttggagcgtgggggtggtggaaaagccactgcgaaacgcttcactccacgcttcaccggataatatatgtggtgttcgtttcccgggacaacaggtttgccaatcagtttctgctgtttttgcactctgcatgagggaaaaaataactccggagcgtgggttagtaccgggaagtggggttagattcgacagtatgggcgatcgcaatggtggggggcgtaactattcacctactctttttcccactctcttcccaacctccaaccccccacgcttcattccctgaaaatccagagaggagggcggttttgaccagggtaacgcccctggtggatctgtggtgttaccctaactcactgtgtatgtttttcctctaaactctcaaaaaaagaacactgtgctgcgtcgctgtaacgtgcattcttgcagtactaacagcataacgaggcgacaacggtgcgacaacgacggaatacaacgttttggggcccacctggaagtatatgggtcggtcatccctgatttcagccattccatctcctcttttaccccaatggccgaagcatctgtgatccccttttatatgagggccgacgtattgtttcagctcatcaggcaattcatggttcgacgtttaccgttacttgcatagatgggtataccaacaagagaacccacggtatgcaatctgcataccgtgggttgcccactcccacaaatataaccaccaaaaaaatctgatcagtgccacgtgatgcatatatatttcccgagtagggtaacctaaagcgagaaatgatgctcagtcacgtgatgagtgccctgaaagcagcattatatcagagcactaaccaaattatagattcacgccgccatagtatcagaatactaccaacgacatcgaacaactgtgtacgataataagatctacactgcctgcttccaaaatcttatctcctcttctctgcacatcttatcagtatgagtagtataaacagtataaacattcttcagacagaaactacatgaacggctgagcacatggatcctgatctcatcgtaatcagaaacctttcctggataagaatttctttatctatctcccatctgtcttctagcagattcgtcaaagggtcatttctacaggcagtagaagtaaacccagctttatctctgttttgtatattaaatcgatcgctatttgataagaaaggctttttagtccagtgacgttctacgaaaatatggtcgctagtcatcattgaaagactcaaatggtacctattacccggattctcgcgtggaaaacgtgttgcgttcgaaagtgccgtatgttttcccgaagtgccattctcgaggcatcgccggttcctgaatatagaatattccctacagccctttctttgttgcgccgcataagtaatttttccggtgcaaaggtttggaagtaaattctagtctttgcttttttccatttagtacccgtttcttttcgaagtgttttggcttttcttatccatcctttcgctgtttgtctttcgcctcgtgatatcaggttcttcccagggcctgactgctgttcattatgttatagtcataccctcaatcgtttcagattgatgacccttgctgataagcctttcaaccgtgaagttttccctggtatatcagtccccgctctgtttacatattggttttagttctttttttttttttattacttttagcattatcgtctaatctctccaaccaacatctatgcatcgcccagtattcatttgataaccatacacaattactgcgtacgtcggaatctcaaccttcaattcgttcccgtcaaaagccaggtgatggcggagagtttagtttaggtgaggaaaaagttggttggtcgcagatcctctctgtatttaaacaacagggtctttcgattcattctttcctttctattaatgttcttcttacaattgtagtattagtagtgataatagcatcagcaaccagtaaatctcacatagattaaatcaattatggctgaaaaggtttacttggacgcacagttgtccagagttgacacagacgaagatatcgaaaagcaacaattgtttggtgatgataacatagtaatcgagagatcttcgcaattattttacgatggtcaatctgatagcaaggttcatggtataacttctggtcatggttcggatgttaagaacgttgttactcatacgtcagaattcgatggtaaacatgatggtatcagattgaagaaagctctagaggctagacatgtttctatgattgctattggtggttcccttggtactggtcttcttatcggtacagggtcttctcttgcacttgcaggaccagctgccatccttatcgcttatgcgtttgtcggattgttggtgtttttcgttatgtcttgtcttggtgaaatggcagcttatatccctctagatgggtttacctcatattctactagatacgcagaccctgccttgggtttcgcagtcggttacgcatacttgttcaaatactggattatcgttcctaaccaattgaccgctggtgctcttgtcattcagtactgggtcgatcgtgacaaggtgaaccccggtgtatggatcactattttattggtcgctatcattacaatcaatttcttgggtgttagattctttggtgaaatcgaatactatatctctgcagtgaagattaccgtcatgctgggtcttatcattttgttgttggttcttgcatgtggtggtggtccaaaccatgaggtgttgggtttcaaatattggaaaaatccaggtgcattcaaagaatactctactgccatcactggtgctaagggtagattcgtgtcgttcgcttcggttttcgtgctagcccttttcgcttatttgggtactgaactatgtggtatcgttgtctctgaatgtaagaacccaagaaaagcggttccaaaggctatcaaattgaccatgtaccgtattatcgttttctacttgatttccatcttcttgcttggtatgtgcgtgccattcaatgatccattgttaattagcgctaagagtgccaagacatctgcatctgcatcgccatttgtcgttgccattgttaacgcaggtatcccagttttgccccacatcatgaatgcttgtattttgatctttgtgttttctgctgccaactctgatctttacgtggcttctagatccctttacggtttggcaattgataacaaggctccaagaatctttgctaagacaaacaaacaaggtgtgccatactggtcattactggtaggtgtcttatttgcattattagcatacatgaacgtttcttccggtagttctgaagttttcacatatttcgtcaattgtgtgtctatctttggtctactaagttggatctcaatcttgatcacatatatcagattcgacaaagctttcagggttcaaggtatcgataaatcaaccttggcttaccaatcgcctttgcaaccatatggagcttggttctccttattcttttgcattttgatcggtttgatcaaaaacttccctgcattcttaggtgacaccttcgactacaagtcattcatcactggttacattggtatcccaacttacatcatctcatacatcggttacaaattgtggtacaagaccaagatcatcccatccgaagaagttgatctcgtctcattcaaagaagcagtcgatttggaagaagaagaaggtaaaatgttagatgaggaaagagctgcacatcttgcagcacacggaaaggatctcaaatggtgctacgaaaagatcttcggctgggtcatgtgaggcggttcctgtttcctccccccataagtatcaggtaatacaaatcaaatttgcatatacattaataaaaagaagcgaataaagactccttaatcatatccggttgatacaggttcggctgtattctcctcgtgtcgcttagtttacatttctttcccaagtttaattcaatttcttcaacaaagatttagagagtatacttgcgccgtcatcatactggctgcctttccgtttcatcaataaatatatgtattctctaattaattttatgctcataatatatcggttgcacgagatggtcattccgatggtttcagactctagttaaaagaagaagctagatgctgataatattgatttcggatgttactgattgaatattttgagctattataataatatcaacaaagaaaattttaacgtgggttgattcttaggtttaaaaagacccatcgtatatctcaccaaatatcggtaccgtattcgaaggataaggactaacgacttaatctctaacttgtggtaactaaatttagtcctttatctacaatttctctatagagcattcaacaaagattgtggtttttatctatcaagtattattccattactattaatgtacttataaaattctgtatatgaagagtatcaagaaaactgtgacttctccacatcagtatagtaaagccaacaaaggggatacctttgcagttgtagcaactattggcgtaaacgtttcaaatggggtaaaagaaagaaataaagagtatatcgttcatatatatcatttagaaatcaaatcactaaaattcgattagttcttagcgttggtagcagcagtcaattgagcttgcttaaccaagttagatggagcatccatagttggcaacataacttcgatcaatctgattctggtgttgtcttggaacttttcgtcagtggtcaacttgttccattcaccagtggtggaaactctgacagcttcgtagtccttggcaccgaaagttggcaataattccaagtgttgccagttttggatacagttgtattgagcggtttcaccgtgaatcaatctttcaatggtgtaaccgtcgttgttcaatacgaacaagtatggcttcaagccccatctgatcatggtggagatttcttgaacagtcaattgcaaagaaccgtcaccaatgaataagataactctcttctttggatcaatttcttcggcagcgaaggcagcacccaaggtagcaccagtggtgaaaccaatggaaccccataaaacttgagagataccgtatgtgttgtttgggaaatgagtttggttgataccgaaggcagaggtaccggtttcagtgataacaacatcaccttctctcaagaattcaccgacttgagtccagacccattcttgcttcaatggagtggagtcagcgacagcttcgttgtgttctggttcagatggaactggaactggcttgtaacccttagcagcatcggcaaccttagtcaacaatttttgtaaagcgaacttcatttggacacctgggaaggtagcgcttctgatcttggtgtagtcagagtggaattcgacaatgttcttggtcttgtaagagtaagagaaagaaccagtgttgaaatcggacaatagagcaccgaccgatagaaccaagtcagcagattcaacggcttccttgacagctggagaagatagggtaccgacgtagacaccaccgaatcttgggtgcttttcgtcaatggaacccttacccattggggtaacgaaggctgggaattgagtcaagtcgatcaacttcttggtctcagccttggcatcgtgtctggaacaacaagcatcagccaagataactgggttcttagcttccttgatcagttgcaagacgttttcgatgacttcttcttcggcttctgggtcatttggcttcaagctcaaatcaattggagtgtccaacaaagaagctgggacagtcaagtcgaccaagttagctggcaaacccaagtagactggtctttgggaaacgtaagtggttctgatacatctgtcgatttcagctggggcagtgttgatatcggtgatcatagcagtggtttcagaaatgttggaggacattctgtggaaaacagtgaagtcaccgttacccaaggtgtggtgcaacaacaattgcttagcttgagaagagacggatggaacaccgacaacgtgcaagacaccaacgtgttcagcgtaagaaccggcaataccgttcaaagcagacaattcaccgacaccgaaggtggtgatgatacaggacataccctttaatctggcgtaaccatcagcagcgtaagcagcgttcaattcgttggcattaccagcccatctcatacctgggacttcgtagatattgtccaatagggacaagttgaaatcacctggtagaccaaagatggtttgaacttcgacttgctttaatctttcgaacaagtaacgacctaatgtaatttcagacattgtaatttaagttggttttgagttgtagttttatccttaatattaatagttaatactataatatgtttggctttagtggatggtttttgaggtaatcaaaagtatataattaagattatgattaagacatgatgggaaactctagccattacagataatcatgcccatgtatttatactttatctgagttaactaaaaaaaatagaaaggtcatattcaccacccagccagccctgcctctcacctcactctccccccttaatggataattgacacaagtggtactactattccaaccttaagatattcatgggccaatactacgtatacaccttaaaaggttgaatcttttcacaaatattgcataatctatcccatggttctacatagcaaatacagaatatgcaaaatacaggacacgcacaagggccagcaatggttagctaatttgaataatttccaataccatgaaattatcccaccttttaccttggttgactctcatttccgattttctataccacagaaaccgcaccacacgcccatttcccatttcatctattcactttcactacatctaaaatcttcctcttcctctccccatgacactcgttgtatgggtaccaaaaggtaaaaagagctcacattaggaaaggaataggacgatgtagaagagacttacttactcgttgcccatggaattgggcattggcatcgccaatgccattcaacaagtcgcaatggaacagaccgaatttactggaagcgcaatcctgtaaaaagaaatacctcagctgaattccagtttacacgaatccctcacagagatagagttgtatttgtctgggatacggcttggaggatgtctgctttggctgttgttaaaaatcgcatcaactgatccgaggaatcatcagtgggaacgacgtgcatggaaaagaaacgtgctgagagtgatgggcttagttgccgttatttgcattttgaaatgcatataacggtgtatcttccctctagttgcatatctggaatatctgacgattttcggagaattttggagaaaaagaaacttttcggaaaaactaggaggctgcaccagagataagcagagagaagacgttgctatatattacccgggacaatatatgcattctaggtcatgtgactggaagcttccctctctggttgtcatgtcggagtttgcgctcaattcgtcgtttatacaggaatctattttgtacatagtggattctcttaatctacgccgagattgttgaaaccggacctggatttggccctcattctttctatacgtgcctttaattggttcgtaacttctgcagctcgtttccacgattcctcttgcaacatatggttgttcaagtttagggaattgacacgtctaggtagatcgtcgctactttcactaggcgatctgaccctttgaggagtcgtagcatttttagtagatctcagaggtgataaggtagttgctgttaatcttcctctgctaatggacgaggatatgggtgaatctgttgacatggtatcggaagtaccgcccgtcagtttactctctaactccttgatctttaaattcttagcgttcaattgatccttcgaatcctgcaattgcctttgtaaattggaaacgtatgtctcagactcgttcaagagtttatttactttggaaagttgtaaattggattgatttaagttggataagagatcgttgcgctcccttagccattcttgtctctcttgtcttaatttgttcacttcatcgtttaaatgtgacattctgttggatatgtttgtctgtggtgtgaaattgccagagaggcttgtgttggaactggtattagatttgggttgtgttgaggaaggcagatccgtatggttcatcatttgatgagtagttagagaccttgaagtcaacctggacgacttcgtgttgccattcaaggcagagttacgtgccggtttcaatggagaagtggccagtcgttttgaagggatcgttgaagacaagggttgggatcgtactactggtgccgctgatcttaattgggtttgcggttgggtttggtgtggaggtggaaccgttgccgccttgatctccactttatcaacaagttcaaggatcttcttccttttcaagttatcgagcttgtccaaatatgttgatagttctctttcatcgaatatcttaattaagatagcaatacacttgaaaccctcatttcttgttgcctgttgattgtcgtttacaatgggctgcaaagaattgagtatcgctggcaaattggagaataccgacgttctatgaagagtttcagtcggtgtccaattggatagcaactcgaaaagaaatttcgagcatacaatttttacctgtggtactttgttcttcatgtgttgtaacacagactcgagacatagctctaatttatagtactttgaaaggttcaggagagcattgaaaatagaatctgcgacgtttggttttttctcctttgatctagttaggagagcgtttaaagtttccaatgcgaatgggttatattctgatcttaatgcggatattagtatatctaaactgctggtagatatttgtactgcttgtaggtttgcatcggaagtgatagtcgagcaaaatttgtgaatgatttcagaatgatcttcatttgatgctgacaattttttaaccttggttaaagtctgatcgtggaactcttctaaagcttccactctatccttccatttgctagacgccaaactctgatagaaattattcggtagcttatctaatatagtttgtacggggaacatatcatatggatcgattgattggttatccagagcagcggcagactggccgttattacctgccattgctagatctccgtcatgatccaagggtaaatcagttgaattgttatcactctgagccgggactgcccatataaactgagacggtgttgaagaaggcggtatagtgccctggtacgattcaaacagtttatccaggtccttctgttgtatgggcttcaacttccccaatagaagctcttgaagtacaggtttattaaaccatgtatatagttgtaaaatcaactgcattgactcattcctcacagatttatccgcatgtgagcaaagtttaggtaaaacttccactagaccctgtaacgattgcatcttctcctgttgagaaacgttcacgaacccaaactgctctatcaactttacatgaaccattaacgctgcagtcaacagcttcggtaattttttggtccaaatcggcgtcagacaattgattgcatttacgatattatcatccaatgacacgacaagcgaaacgcaggccaatgaagcctctttcgtcgctgatttcgaggaagtcatacctttctccaccagagctggaacccagccctgaaccaattgacccggctgacacaaatctctgatctggggtacgtcgatcataaatttcaacaaactgtacaaggccttaacggcagattcttgtgcaacaacattggaatccaatacgtaccccgtgaaaatctcaggtttcttccaatacttattaacgccactctctgcaactctagcaacggacagtttattgaatgtgctttctagctcattatatccatgctgtcttgccttccaaagcttatgaacaagtctctcatctagtgacagagtctgaaaagacgccgaatcatccgtagcgttatccatgggagatatacacacgcgatacagctggcagcaccctgtgttgactcactgaccgtctattttattcatgttgtctcgtctgtttgtttgtttactggttgattttgattgtttttgtttacagaaacgattgatttcaagtcatgtgatatatcacgtgactttgttgatatgctttggatcgggtttgcagaaacctgaataatgggagggtaggatctattatacacgtacacgcccctccaatcactcaatcggcgctgatgcgtgttggttgaacattatacagtcaattcaagccattcaaaacaccgttacacgagtgttggcgcttccacctgcttacaaatggacgggttctagctgattccagctctcgattcctgattagcaagcaaaaatttgtcaaaaactcgatatttaaccaacattattatataaaggaagtaagatacatttaaaggttatttagttgtctcttcgattgattatcggataatctgataactttctatcctcatcaaataaggtacaatttatctttactatcccctccaatttcatatataatggtcgctcaacttacttccgcatccgaattcgaaaaggctttgactgacgacaagttggtcgtcgtcgacttctttgccacctggtgtggtccatgcaagatgattgccccaatgttggaaaagttcgctaaggaatacgagggtaaagctaccttcttgaaggttgacgttgatgagttgccagatgttgcaaagaacaacgatgtcagtgctatgccaaccctagttttcttcaagtccggtaaggaaatttctagagtcctaggtgctaacttggctgctatcaagcaaaccattgctgctaacgtgtaaaattttttgtacactgcttataatatacattttactatatatatatcagaataaattctttacatttctattctttgatcatggtttctatctccttctcagtgtgccccaggatgtataggacgtctatcattgtatcactgtttaacttacatggggcttgttcttggacctttggcttggcgttccatgcgattccgaacccagctgcggccattgcgttcaaatcattaccaccatctccgaccatgacggtggattcgatcggagaattgtactgttctgcaagagccaccaacgtcttggccttgcgcactccgtcaactatatcgccgagtgcttcaccgttcaattgttcagtaccgtcatccgacacttccacacccagagtattagccaatgcaaaatcgaagtttaacttttccttaatgtagttagcaaacgggatgaacccaccacttaacactgccaatttacaaccttgggacttcaacgccctcgatagctctgggacacccttggtgactcttaatctaggtttaatttcatcgtataagtgtctcgtttgaattcccttcaataatttcacacgttctctcaaagattgacagaaatcgatctcattattcatggcacggtccgtgatcaatttcacttgaggttccacatccgcgtatgcggcaatcatctcgatgacttcttggtaaatcaaggttgaatccatgtcaaaaacaaacaattgcttgttctttctgaactcattgtccaattgcacgatgaggtctacaccagagaacaacggttccactgtggaaacggcacgtttcaactcatctaacccaccgtccgcaactttcacataaatatcaacactcttgcctttgcatagccatctgataccctgagtacctttctcgctgtttaattcgacttccttgctcgaggccttcagctgttgaatcagctcttgttcgactttcgtcacagagatgttctcgcaatcagcacggtgcgctatacaagtaaccacacagtcaacaactgacatattcgttatttctgatttacccagcagcccctagtagataccaaataagacacagaaccctatttcaattcaaatcgttctcattggcacttacttccatcgatgattcatttcgaaagttcaaaaagttcgctcgaaagcttttacttgaacaaacatcgaaatttttcacctggaaacacacatttcccacacacagagggcattaacgttgatcattagcatctacctgtagactcttgagttgcttgaatcaccgctagacatattttctgttaaatctgttctagcttccgttattcgtcgctcctgaatcgagacttattgacatattattcaattcaaagaaataaagtcacctccaagtcatgtcgtccaagctaagaattttggtgccagtgaagcgtgttgtggatcatgccatcagacctcgtgtcaacaagcagtttaccaacgttgagaccaagaacttgaagttctctatcaatccgtttgacgatattgcagtggaagaatctgtgaaattgaaggaaactcatcctgatgccgtcgaatcaatccatgccgtttccgttggcccactgaaggcccaagatgtgttgaggacagctttagccaaaggttgtgattcttcaactttggttgagcatgattctaccgaattggagccattggtgatcagcaaggtgttgaagaaaattgttgaagacaagaatgctaacttggttgtgctcggaaagcaagccatcgatgatgatagcaacaacactggtcaaatgctcgctggtttgttgaactggccacaagctaccaacgcttgtaaagtagaattgttagaagacggcgccagtgtcagagtcaccaaggaaatcgacggtggtgaagaaatcgtggtcgcaaaattacctatgatcatcaccactgatctacgtttgaatacgccaagatacgctacgttaccaaatttgatgaaagccaagaagaagcctttggagaagttgaagttgaagaaagattttgaagggatcaatttggacccccaattgaaactgctaaaggtcgaagaacctccagtcaagagtgctggtatcaaggtttcctctgtcgatgaattggtctcaaagctaaaggaagccaaactggtttgaacactacttctggcttgatttgaaacattcgacttatataatattatgaatgatatgtggttattgtataaaatgttaacacgttgtataagttaatataagagtacgaacaatttctcagtttgcattatccttgtcaggggtcccaagtttcctcatgtctcgtctctttggtgccaaatgttcgagtagtccctttggtttcgatgcaagatacgtctcctggtaccatttatcgaacgtctctttgctctcttgtcgttgccgtatcaattcctcgatatcgctattaaactgtattacttgctgcaattcagcagtgtctgtatccggcagcaactgaaggctgggcaaagttagcttcttcctccccttgggccatttctccgacgattcaactccatggtataataccactttccttaactttgaatccattacttatgatttgcctggtgatggtggcgaataatctccaactatacaatctgatctcaccgaaggctactcaacctgctatgatactattgaagtcgtctgatatactctctctgtaccctctgttcatcagtttgttgcaaacaatatttaaaacttgattcattcatttaacttcattctatggttgatattaatttcaattagacacataatgccacatgtagcgacacacaatgagcgataccagtgaaacaatatgttccatgtgtcaattgttctacgtgaacaaatgggtgctcggtacaggtggtggtatcggcattaaacaggacaacatcgcatacatatcaccaagtggcattgagaaagaactgttggaacctgaacaaattgttaaatacaatatacaggacgatacttatcaatgtggtgcgcctggattgaaaccctctgcgtgcacaccgttattcctggagctattcaagacgctgggtgcctcgtgcgtcatacacacgcactctatcaatgcggtgctttgttcaatgatatatgagaaggagtttaccatcaaggacattgaacaaatcaaggcgatacccaaaggtgacggtaccaatttgaggaacgttgataccctacgtattccaatcatcgataacgctccagaagaacaggatctcatgccagcgttgaagcaaatgattaaggattatccaaatgcatgtgcggtactggtgaaaagacatggactcttcgtttggggccccacgccaaagaaagccaagatatacatcgagtccatcgattacctctttgaagtagctctcaaaatgaaagaactcggtcaatgaaagggagaccagcagctgtgtataacattatttatatttcatctgttagcccatcgctcactccaaatgtctatttcttctttaaacggtaacttattcttacacgctgggaacttctgaagttttgccagttctttttcttctggtatatcatctatcagcccacataataccacttcactactccgtataatgcatatcttgctgtcctttaaaagaatcatgtttcccgcatgatcaaaccctttcatttcaccatagtatgtgtctccatcgacattgaccaacatcaccttcttgtccaaataatctttcaatagagcactcattgtccattcactgttctagcaaacaagggggcagttatgtggatatcttcgctccgatggatcgttatcttttcttcgttactattataatttgaaagtaatgttttctatttgaagattctctattatcaataacaacaacatcttcaacaaagaagaatcacacatcataacagaagtatacaggcttctacagcagttatctagagttgtgttgtggctaatattgttagaagctccgaatcacggttgaaatggcggaagagaatgaaagtgagaccgattacgggtcttctccctttaaaaagattccagacgccgacaaacagatcttagaatggactagtcgtctagagttggagactgtgcagttgcgggacacgtctgagagtctattcaagattatcaaggagaacgtggatgaattgagccattcgcgaaagttattccaagcagaacttgacagtagaaaaggtatggtttctatgcacaatgaaaggaatatctacttagtataagggcatttacttagttctatctacgtggattggtcgttgattgataccctttaggaatgattctttgtaagagtcactacggtcagtttttactaactaggaaaataacggatgagactccgagaagtcgccgttatttctgtgtgtatttagatggtaatcaagaaacgggaacggagattgtctctgaagtaaagtctcgtttggatcaattaaaggcatcaagcggtgaaagtttgcaacttttagcggataatattacgaagcagatggataaacgacatcgagaatggatggacagatttaccatgaatgaaaatgtcatgttcaatgtcgtgcaacaaatgcaagacctcacggatgccatccagacgttgcatgaagatatgaggttagctagcaagaggcaggcgttgcttgagaaaagattgagacatgaatctatcgctacgcctgaatctcaacacctaaatcaaaaccagacacaacgactcagggtattaatcccctgggaagaagttcaagagtgcgaaatgaaatgattgaccacatttctgtcggcatcgatggcaatggtaagatttgttttgccgaacgcggtgttcgggtcaatgaagtttttataatatagttcataacaaggcatatatctatcaacaaacgccttcacttgcgcatcagtcattccttcgccctgagatgctagcatagcatgctcttgttgtaacctccacctatatacattgttggtgtcgtcagttgcgaacttgataccgacagtatccaatgactcattattccatagcaattgtccgtactctttcaacgaacggttcacttgtttcagatgtaacaactggtggttcaacagtataggtgacgaatttttcctttccaattctgtttctgtaatggcttggaacccaaggaaccatccctcgatgatcacacagtccaatggcaattcaatatcaatactgccaatcctgtctccttctccgttaaatctagacttgtcatatacgggcaactggatctttttaccatcatgcactttgtcttcatcatttgcaagctctttcaatgtctcttgcaatgctttcaagtcatgagtgcccggtaacccccttccatgtagtaatttattctctgggaatgctgactgtaacttcaattggtcctcatgggtcagataaaaatcgtcaatggatgtcaatgctgctctcacgcccttcttcttcaacgaacgaaacaatatctcactattatacgacttaccagacccttgtggcccggaaaccaacacaaacaaaggacctttcctgtcaccttgaactttccgttgttccaatttctgttcaacaaactccacgcttaactctgcaacgttcatttctattgcaatctctcttcaaacccagcaatccaataccatacggtggtttcagtctccaatggttgcagatcttgccggtagctgtgtttgcctttaaaggtttcgtcttcaaattgttctcttaggcaagaatttcggcgataatcaattcatacctttaaaggtttgatgactctcatgaacaaagcctttgaacacaccaaaaaaagaagagaaaagataccatactccacaccgttgtgacttcaaagaggggtatactggattggtatatatacgggtagatacttagaccagttaccagtgctacttaggtgttaagtagagagaacaagacagttgaaatatcctacacgacactggagatttggagaaataaagtactagctcagaatgaacaagcttcactctttgttacggttacagcaggttagtctgaccaggtatagaactgttagcaaacctaaggctcctcctggtggtagagggacgtttggcgggatattggtttcacaatcgcttttagcttctttgcagacaattccggtagatttcaacccgagttcgttgcattgttatttccttatcggaggtaacccagaccatgatatcgattacgatgtagaatcattacgttctggtaagaatttcattcataaacaggtaaaggcgtaccagtttgacaaactgatattcatttcgacgatcttgttctacagacaaccggaccctgataagctacatgcgttgaatagacttggcaagttgcccaagttaccagatttcaagaaattccgtgaatcgacacagttgttcgagaaccaggtgatgggcaagctgcccaatttcaaacgtgtatcaacagtatttcaaggctctgatgccgagaccaagaagctccgtgatcgattcgaaacaggtaccgttgattaccggttcccggacaacttctttgttaatgagtcagattcagatgagttggattattacttacgtgtgcgtgagaatatacctgcaagtggagttcctggtttctccccaaacgcagatataagcccggagaatgatgttcgttttaactatgtcgcatttgcgtatctttctgactcgtacgttctattatcattgccatttttccataatcttccaatgtattcacacaagttcagtgtgtctttggatcatactatccatttccatcaactccccaaggtaaacgactggatgtttgccaaattgttcaatcccaggtctcatcatgataagcatctgatcttagggcattattacgagagaaagtccagggaattggttgccactatctcacaggaaggtttggttgcgtacccagagaaacagacgatattggccttatttaaaggtgaatctaaattatgaatccgtctattactgttcatttttatttgtcattagaaccgtacgtattgttgcttgtatatttattatatatataggaaggtaggggcgaacagaattaacttgaacttttccgacttagaacataccgtcaatttcaccgtcttcgttgacttcaacgttcatgaaaccacaatgggttggtagacctggaatagtttggatttcagcagccaaagcgtatagataaccagcaccgatagaagctctaacgtctctaattgggaacttgaatccagttggaacacccttcaaatttgcatcgtgagacaatgagtattgagtcttggcaatacagatcggtaagttgttgaagccttgtttagtgtatagatcaatcttggcttgagcttctggtaaaaattcaacttcacctgcaccgtacatttctttagcaatggcagagatcttatcttccacggattgaccttccacttcatacaagaatttgaagtcctcgttagattgattgttagccgtgttgatgataccttcggccaagtcaactgcacccttaccaccttcttcccagtggttggatacaatagcatcaacagcaccggctttaattgattcttctctgatgacttcatgttcgttgtcagtgtctgaggacatcttgttgatggcaacaacaactggtaaattgtacgctcttgcgttagagatatgcttagccaaattagcgcaaccctttctcaataattctacatcttcattcaagtattctgatggcaatggggcaccagccttaacttctggaccaccaccgtgaacctttaaagctcttacagtggccacgatgaccacaacatcaggcaccaatccactggatctacacttaatgttaataaatctttcaccacccatggtgaaatcgaaacctgcctcggtaacgacataacccttttgagttttcttcacgtcttctggtaagtcagttggaacaccagccaacttcaatgccattttatccgctaagactgagttagcaccgatggaaatgttggcgaatggaccagcgtgtacaaacactggggtaccttccaaagtttgcataatatttggctttatagcatcctttaatagagctgtcatggcaccagcacatccaatatcttcacaagtgattggttcaccggatttggaagcagcaatgactattctacctagcctttctctcatatcttccaaagagttggcaagggcaagaacagccatacattctgatgcaactgagatatcgaaaccggtatatctggtgtggccacgttctgttggggcttggccgacagtaattcctctcaagaatctgtcattacagtccacaacacgtcgccaggtgatagtttcagggtctatatctaatcttgcaaatctggcactttcctctgcagacaattcgtttggatctgtcttgttgattccaagcttctttagtcttcttaacatggttggagtgaactttctgacacccttctttgctggcaccaatctcttatacaaagctgcatttgattgagtagattcatggaacattctggtatcaatagctgctgccaacaaattgttagccattgaaatagcatgaatatcaccagtgacatgcaagttgaattcatccattggaattacttgtgagtaaccaccaccagcggcaccacctttgataccgaaagttggacccatagacggttgacgaacattagcgaaaactttcttcttcaaatgagcacctagagcttgagccaaaccaactgtcgtagtagatttaccttcacccaatggagtaggtgtgatacctgtgacaagaatgtatttaccgttttccctgtttttcaatctgtttagtagatctaacttgaccttcgcctttgtatcaccgtaaggttccaattctgagggtagaataccagattctgcagcaatttgtgtgattggttttggtacttgagctctagaaatttcgaaatcagatgggactggtttcaaaagatttaacttcaatggttcgaaatcgttaccagagttcaactgtttgtccaaatatctcttggcactttcaaaagtgttttgcatcaacatagccacagtcattggaccaacaccacctggaacaggggtgatcaacttaacgtatggttccgcagcagcaaattcgacatcaccgacattcctataaccggatttcctggtttcatctttcacgaaattggttccaacgtcgattaccactgctccacgcttgttattagcgaaccattcacctctgatgaattcaggttgtccaatggccactacaacaatatctgctctactgataaactctctcaaatccttagatttagagtgtagaatagtcacagtagcatctaaagaggttagcaaagtagccactggagaaccaacgatatcggatctaccaatgacaactgcttcagagccagcaatagtaactccagatcttttcaacagttcaatgatacctcttggagtacaaggttggaaataaggagtaccattacgcttgttcaattcaccgatattgacgggaccgaatccatccacgtctttacaagcggagacacgtgacgtgattttatcctcgtttaaatgtgcaggaagaggtagctgaaccaagatcccgtgcactgaatcatcgctattttcatcgtcgatctgaccgagcaattccacttcggtgacagtttcatccaaatggataaatttaacatcgattccagcatctttagcagcctttaacttcatcttaacataagtgttcgaatcaggtctgtttccaacttggaaaatggtcaaagtgggacggaaaactgcatatttctcctttaaactagagatttcatccttaatctcatcgcgaatgccattggcaatagctttaccgtcgatgatagccataatttccgaataatgtatgggtatagaaccttgcgtgatgatgcttctcgaaaactttaaactggattagagttggattctcgaaacaaaaatagatcacctcttgctgtatatatatatatagtcagcccagcgatgaatataaccccgacactgaccaattgagctatcaagcaattgatgaacacgataaagagacctgaatgtgaaaggtagggccattccaatggtttctgcatcgtttaggtaccatttgattccattttcatttttcacagttcaacaagtcaaaaaaggatattcatgtcacgtgacatgcatgagagatacgttccaacaccttggaacggtaaggacgagcagtatatggcttgtatgtcacttgaatgcaagcaaaatacaagttacgtatcaagggtcttcttgttcactagcggaatgtttgtataagtacctatgaatcaactcatatgtatggcttcatgtatctgactctgacgcgcgtcacgcgtcagagtcaaatcttctctttcggaccaaatgattccctcagaaattgctgtacgataccggcattcggcattgtttttttgactgggaaaacgtatcacgtgaatatcacgtgaataaaggctgtttcctgaattctgagtctctgtagttaagacacttgtgatagaatgattactttcaggttggaaagatgaaagagtgatagaatggttcattcaaatgctacatactccgatgtaccaccaatacagttagtgatatattatatgggacagtgttttcaaagcgcacaactgagtcttttacccaataacagcacatttccagactcacatcacgtgactgaattgtcacattcactcatttatatataacgggaaaatgaattgaatgggaattgaactgaacagtaacagcaggtgacaatttaactacactgtacatattatgtctccattattgtgatatataacccaatcttataatttatctaccccacaatttcgtcatggcaggtacaggacttccagaaccctgggttatcaagtttagtagatcgaagaaacgtgaatacttcttcaacccggagactaaggaatcggtttgggaggcaccgtcaggtacagatgaggaccaatcaaagaaatacttagaggagaacccattgagggtcagagctttgcatctcttgattaagcacaaggattctagaagaccagcgtctcatagaaatgaaaatattaccattactaaggatgaggctaaagaagaattagaaacttatatcaagagattgaatggtggtgaaccattcgaatcattggctaaagagagaagtgattgttcatcagcgaaaagaggtggtgatttggggttcttcggtcatggagaaatgcaaccttctttcgagaaggctgcgtttgctttgaaaatcgatcaagtcagtgatattgtagaatctgacagtggtcttcatatcatcaaaagagttgcctgaacaggactcttcaccataaatcgggtttatagttttctgtaacagcttcatctaacccataattcgattgccagtagttaaacccgcctttcaatacccatatttggaacctgttcaactgagattctggtatcgaccgtaaaaatagcatagcagagctaggacctctctgttgtgattgtgcgcaatggaaaacgcagttaataatttctgatgcaccatcagctccgatttcagctttatcaagtaattcttgtctcaatgtatctacgtaattcagatccgatttaagccttctgtaagggtagttccaggatcccttgatatgtccacctatatggtctgaacctcgaacatcaatgacttggaatggttgtcctagagatgtgtgtccttgtttaatccactggtataggtctattgcgtctagatatttcaatgaagatatggaatgcgattgcatgatgaacttacgttgcaaaaaaagcttcaatcaactgaggatccagtaaaaaagtgtctatttcgaggaccgtgattcgctgctatttgaattaacctttctattctccttcttttctttgatcgttcacttagttaaatgagtggttaaagttaaaatgtcaacgaaatagggcatataaaagagagagagagagaaatgtatgtaagtatacaacgggtacaggatacatatatgcgaacgaagtagaaatgatatcaaataataaaaagtaaaacaacaagtatatgaggcgtttcaatcggtagttggtgacctttccctgtccccttcctcttcgtcgtcatcttcatctgaaaacaaatgattcggcgattcagaactacctctatgcagttcaggatcactatcactagttggagattcaacctcttcaccagtgtagtctttcgcgaattgagttactggggatctacccgaaatccttttacttcttctaacgctttcatgacccatgggtccaataagttttgaatacaacttctttccaagtgtctttttaagaagcatttctctaacttcgaaatacaagtcctttgatgcgacgttgacagattcttggttcttcttgaaatacgatctgaaatcttgaatatgtttcttgaattccaattcgttcttcttcaaccaagatacgttcaactcctgtctcgtggcacctcttgcgaaatttctcatcaagtacttgtcatagtctctgatgatcttggtgataatatcactggtagaaacaccttcggtacgttgggtagttaaaaacttacccattgctttaattggtctgtagatatcgtcattatcagcactagcgtatggtagatcgtcatgtgccacataatcgatcttgtgttcttctaaaaatttcggcgtcacagtccatggggcatccggtatcacttcatcaacccatctacaatgtgtcaacgtctcgcatctctgcttatcggtaaggacagtcaaccctttcaacttgtgcgtcactttatcgcttggaacaccacaaatcaacgtcacgttggggaacgacttcttacactgttccaattgtttcatatgacccaaatggaaaagatcaaacacaccatccgcatatatacgaatcggacgatctgttggtggtaaattgaacttgaagcccttaggtctaaactttctatactcaacaggtagctcttcatccaactccttttccctggccttgaaatcatttgtttcagagtgtggtcttttccgcaaaggaccttccgattcctcagtctctgcatcttcgctggttgttgttgttgtttcagatacaatcgatgctgctgcatctggtgcagtatcgttactttctactcgttcatcgtcacttactgtcatctcatcgtgggaccttttctttcccaatttgaacaggttagtgaaagaagcacctgtactagaaagacgttctttcaaggaaggagcacgagtaagcggagccattgtgtgatattagtctagtatgctaaagaaaatgtctgttagaaggttaccagtgcgtgcttgctattctcattgaacgaaaggtgtctaaattcaataaaccctaacactaaaaacactcaattataaattcaattgtttcaaagttaccaaattacaattcaaaaccgtgttaccactaccaattcaaccataatcaaccatcagtcaaaccgtgagcatgtcaaaactctgagttgaagacctaaacttatgtctattcgatgcttaatttctgtgaaacttttttgttctttggacgcattgtggtaggtcaagtgggaccattatttttcacatgggagaagtataaacataccacgtgatataaacaaaggccgggtaaataatattatttattcacagtaacaaatatataaacagctaatgggcggttaaacggtggttaaaactctggcagtaacatgtgacaaagcagagtgcggcaaccacctctacaagtcaaagtgtatttcagctgatgtgggacgccaagtatgagtagtatttgcaccagatgaattatgtgggatttactggggagaagaagaaggttggttcataagttggagtcacgtgacgtatacagtcacgtgacataaatattcatttaaccacagaagttagatgaactgccatcaggcgcctggcaatcacctttgcaaccaattatacacctgctgctcgagcaacacaaacggattagagctcttgatgactccttcatgtaaccacacagagtatgcacccattgtgttagccattaccacatcggtgaataacctgtcacccaccactgcgacctcggatggatcttcacataccttgcttttcttgaagtaggccatgatttcgacatggcatcctggtttcttaatcgaatgcaagagcactggtacgccagtgctcttctccagtgtcttcgcctgaatgtgtccaatatcatcgttcgtgcctgcactgttactgacgattagcaactttttccccgggtacaactgtttcaatttatcccattgttcttgatattcaggccatactttgtcgtcatgtggttttgcgaaacagttgtccttatcaaggactatggctttgatgtgactcggtaaaggtaattgtatctcattgaaattcgcatactttatactgggaatgcatagtttaggatctttgaacaatctggctacgttcaaagtagcgcttaaattgaaccctacaaccatttcccaagggctgatgcaacagaatggtatgaggtcggtcagttagccttattacagcagaattgaaccaccatccatcgctaacgcctataaatgccttgaaaaaaaatttgtataatatcaaaaaagttgcgaaatgaagtttccacttccgaaagagttaacattagtaagtttacagatgggcctgagcactcaatcagaccaaataaaggatctcttttattgtagagcatagatgtcttctaaccagggaatttctacggcgtctgcgccaattcggagagcgcagggcccgtctacatcaaatcgtggaaggaaaagaggaaatggcaaccagaatcatcatgccaccaccagcggtagcactggaaatagcagttcggtgcatccagattggaatcctgtaactggcagctcaaataaatgggctggcattaacggcaatgagaaatctatggggactggcaatgggacagatgatgatgactcaagcaacgtgtgtctgatatgtgccgaaaaattgcatatcattgccctatcaccgtgcaaccatcctacttgtcacaagtgttgtttaagacaaagagcgttgtacgaaaagaaacagtgtttgttctgtagaagtgaagttgaggatatcatcttcacggataagataaaagaaacttatgagcatttggataagaaggccaaattggaattcaagaacgagaaattggggatacggtttaccagcaaaaatgttatgaatgatgctatgaatcttttgaaatacgtctcaccgtttggagatgccaataaagattttggatcgtttaagaagttgaacgaattcttgagacaagaacataataagacaatatgtatgatttgtgctgggcataaaaaagcgttccccggcgagttaaaagttatgactgttaagcaattaaagatacacgaaagtcgtggcgaccctaaggatggatttaaaggccatcctatgtgtggattttgctctggtaaaaggttctactctgacgatgagctttataagcacatgaaactttcccatgaaagatgtcatatctgtgatcaactagacccatcacaaccgcaatatttcaaaaactatgaggacttattcgaacatttcaaatcagcccattacgtatgcacggtaccgtcctgcctcgatgccaaatttgtcgtcttcagtgatgagttggacttaagagcacatatcatcaaagaacatcctcatcttgcaggtgatagcagaagagctatgacgttgatagataatacctcaaagaagttcagatcacaaattactacgttctccaatccaacaagaattatagatgcacagaatgaggaatcaaattctgcaaactcaagagatgtcaaaaggaggagaatggaacaaagagcaagacattaccttgggaactctgaaccagacttccagtccttcttaatcatcaatgacctatttaacaaaaacgaaatttctgctcaagagcttcaatccaaatatgaagacttgtttaagcaacacgcggatgatatacaattactaatttacgatttatcggagttatatcattcaacttcggataaacacaaaagattgcgtgctatatacgaaggcattatgaagaagaaagagaatgcagggaaattcaaacctctcgtcgccgattcatcatcttcggttaacgtagtttatggtaaatggggtaaaaagagttcttctggtgttggcgggtcgaacgtgaagttcacgtctctaccagctgtatccgaacctatattctcctccaaagcctcgtatactaatttgcggaaaaatggctcttcttcaccgtcctctccagttattaggagcggtttgacttccaattcatcgtcatcaacttctttaaactatgcgaagaagaatcaatcaccgccaggttcttcaaccgttgtagtgaattcacaaccgaatgtgacagctatcaaatcacctaatccaaccagcttccccaagttacaagctactaagaaaaaatttgttgcacctccagtgaaacagactaccataccaaacccatccacttggggtaagcctcaaaacgacaacgattctatcaacttggattcgttagacaatgcattaccagctagtggtagtaagaaaaagagcaaacaaaaacaactactgttccatattggcatatagatttaaccccgttatatacagcagattgttttaataatacaagaaagctcgctgaaacatttagatattcttctaagctttatctaacaggtatcgtcagctgtctcggacacctttgcctgcataatggacactcctgtctttctaacgtccattccatgatacaatcccagcagaaaaggtgaccacacggagtcgcgctgggatccagcatatagttaagacataaaacacacttacgtgaatcctctttgatgaaaggtaggacttctagatcgctaagatcttttgaggtgtgttttttagctaatgcacttaaactcttgtggctcttcccatcatctgttccaattctgtcagcgatgtattctgcaatctgcggtaaaagcttagaagctaattgcataccaagtataaaaccaagaatcttgtagttttgcgatgacttcttcttgaattctacctcattcttgttcatttcatggccaaccacatatctcattccaaatattctctttgagatatcataatactgtccgctcaagtagaatataattaagtgcaaattcaaagtggaatccaagatgtccctgaaactcttgccattgaatactttcaagaaaccagatcccctctcattgagcttatacttgtagaatactttcgataatatccacggtaccccacaataactgatagcgaaaccaatccttcgcaggagtctcgcaacaccttttcctcgcctatcaacatacgccaaatcaacgtactcttctccaagcgttctcctataccttagtgttgtaattgacaagtatatcaacttgctgaggatcattatctcactaacatacctgttagtgaactgttgtcccttaactttccgtagtacatcctggatcttttgtaacagcaagttttccacagtatcatccttttgatgcgcctgaactatactaggtgcatcagcaaatgggaacttcatgtctggtgccattgcttgtctctcgtcagtttgtgttcttattcgtttttgaagatgttagatggttgaaattgatcaattggagaaatgaagttttatttgattaatcatagggttcgaaaccagagataactaaacccgatctaacatacagttgtttgggctggtaccgatagttcaattctgtgaatttattctttttgtaattcaataaagatatcaacgctatgaataaagtttgggatagaattgttggcagtgatagtgccgatgctcaaagtgtattgaaagaaagatgttcatctccgaaggacgtgacggatttgttgcacgttattcaaaactggacctcagagatacataacaatggcgaggaaacacgatgctggaagtgtgtgccgatgcttgccggttatgtgaaggattggggtcaattggagtttctttgcagaagaatacttttaagaagtagcatacaagagatacggccattacttcttgtaacgatgaaatcgttgatgtccaaccattcagataatacggagcagaagtgtgggaatatactacaacaattgttaattgaagccgaggaagattctggcaatgtttctttacgtttgcttgtagatgctatgtctttggtgttccctatctgccttggcgtttgtagagacatgtttctttcgacagatttccaggacatattgactaggaatttgaattcttcagcggatgatgaacatcttgtaaacggggctcttcgtctcttggctgtttcctgtattgacgaagcagtcagaagattcattgcagagcattaccttaagacgttacaacaatcatttaaggtcgagaagtataaagtactgactgcgttggttttgatcaagatctggtcattcactaagatagaaaaggaaactcttaactcttgcatcaaccttttcatcgactcgctttcgaatggcgaaaatatcgagattaatactgaagctttagcttacttgacattgaagccctctgtcagagtcttgctacgaggtaacggtgatgtatgtttgaaaataatcgagctgatcaagtcacaggacactacaccgactgatctatacggactcttgattatattagcaaacgtaagtgagcacccgtcacagaatgaggatacagtcgataaattaaaagcttcattgaaaaccaaccaagaaaagaatgacgagccgacattggaaaatgttaaggacatagaagagtttaaccgtgattatattatcgatttagacttgatcggttctttaaaatcgataaaactatccacctcatcttacaatcaagccataagaatcatatataatgtgacaagagataaaacacagatatcagaatgtgtgaaacagggtgctggattgatgctcttggtatttttagcacaaaaaaggaacctttctaaagatgaatggtatcttctatcgataagagcactatcgaaaacactcatctatgtgaatccagagactgcgttcagcaaatattcaccgttgagcgcagcaccgttcttatttgaaaatttacctttaccaaatgacaacgctttatcggaacttcaattcacacaattagatacttacgaagcattattagcgttgacaaatttggctactataaaccagggagtagatctcggcaaaatcatcttgagtaatgctcagtattgggatagtatagagaatctcttattggattcatcggtcagaattcaaagatcgacattagaacttatttccaatttaatgtccaatccaatggctatctctgcaaagttcttctgctttgaaaaccctaagagtgcacagaatttcgaaatactggtcaagcttctcgaacttcacgatatacaatctcagagagccgttgctgccatatttgccaatattgcaagcaccgttccgttcatttgcaaagaactatctgagaagcgaaaccttatcgaaacagcaataagagtctttaaaacacaaaacacggatacagacctcaggataagattactcgtactcttgtcatctatcttcaacgccaatgcgcatgctgtcgcatgtgtcaagaatgatgaagaatttgtaaaagaattgcaaaaatatcgtaatactccatctcaaaaagatccattaacaccagaattatcgaaagaaatactttctctaatcaattgatatatagaacaatcaacaaggtatagcagtatgcgatttgtacatccttttatatctcatctcagcctatatttgtcaacgggaatgaggctggatagactgctcaaaatgtaaaaaaagcctatagcccgatttaaccaaacacttttaaatacttaaaccaacgatcaaagaaaaagctacataaaggacctgagctaaccatactgtctataaccatcaacttgcttaaatactaaaccgaaagacagcttacatattatgacagctgaagaggtcgataaggaatcagatcctgcaatagaagatgttaaatcggattatgacgcaattgaacttgggaatgagaatgagaatgagaatgaggttgtatcattggattcaatgaaggcagttatatccagggcttctagcgagcttaagcacgaaaatgatcaaggtgaggagcgtgatttgggtagtgttgagaaagatccgattcttgagaggtatcatgcagcgtgcaaacaaggtgatatgaaaactctacgcgaaatggtggaatcgaaagtgattgatttatcgaatgattatgaccccaaggaacgtgtatctggactacattgggcatgtattaacaacagattgtctgcagttaagtatctagctggtgcaggtgcagaagtaaattttaaaggcggcgaacttgacgcgacgcctctacattgggcatccaagtccggtttagtgtacattgtggatgagctcttgaaagccggtgcagatcctaatattaccgatagccagggctacaatttacttcatacaagcgttttctcatccaatatcatgttagtgatatatgtcctttttttcgtcgttgatgggaaagaggatgtggatcaaccagatccgcaccaaagaactgcattgcagtgggccacttaccaggcagatgcgttgactgtggaaaatctacttaagtttaacgcagatgtcaagaacgcagatgatgctggttttactgctttacattggggtactgtgaagggaagtattcctgttatggatctcttgattaaacatggatcagatttcttccagactaccaacgatggtaaaaactgcttcacaatagggaaagaattgtattctattggcagccttgaagcatctttgtacaagaatggattcgataaaaatggattccctttgccccaatatttttctgctagtactgggaaaatgctaacattcttcttgccatgggttttgattccattagtgttttacatcttttctaaaataactttcttcattgcgctcttgatcaatacaatagtattggttatttctggcttagttctatcaagactcgttgttccatcgtaccttctttccaagagacaccctatacttaactcacctttactagcgggtatcttgtctggtacaatagctatagccttcttcatttggtttacgaaaatatcgatattgacatttacggagaaacctgtcggtaacattatcatgctaggcttcttcatcgggttaatcactctatttattggtcttatgaagtcagatcctgggtacattcctggaactgtagaccatgacaaagttagagagaccattaaagagctattatcattgggaaaatttgatgccaaacacttctgtgttcatacttggatcagaatccctcttagatcgaaatatgacagagattctgcctgtctaatatcggcatttgatcatttttgtccatgggtttacaaccaaattggtttattgaatcacaagttgttttacatgtttgtagtgctgttggaaatatcagtatggtggttcttacctctcatgatggaatattttgatgaattggaagactatttagagaatagaaagggtaaacattttggagattgccattttctaggagacgaagatctatgtttcgggttacatcatgatacattcaattttcttttactgtgttgggttatattccaagccttttgggtactgtgtttgatagcagttcaaactgtacagatgttgaagggcgttacggattacgaatttgttcaaataaataagaagctaaaatctaacggaactaccacggaagatatcttcagctcaaccccaccagaacttatgagtgaagaattgattgctgagctagatgctcccgcattggatccaagacaagtacctcaaaggacgtgcttcacagtttgctgtactttgctaggtcttgacaaattggtgacaatgataaaatcagtactccgtctgaagtcagatgaaccttcttctcgttcatcccacctcagtgcactagcacgtatccctaccgattacgggtggaagcagaatttgaaagatttctggctactacctgatacttcatcaccattatggaggagaatattgctacctccaaaggacagtcatgcactattaaatggaatggaagtggactattacactctatatacattaccaaatgctaccgaagagcttgtatgaatgaagacaatccattaccgtatatattgtacatatttgtatcctcatccatgccttgtaagtagttgtcagaatgttgaatttgctattacccggaaatcgcgttaacatctcttcgagagatccacaaagtatatttacatatcatgcgaagctcttaacatttgaagagaggaagcaattgaaggagtcctcattgataccactcactgacgtcagcgctattagaaacaaggatacaaagcctataagcaatatctgcttcacaactctatctaaacttagagattatgggtgtttctggactacttccgcagttaaagccgatacagaatcccgtgagcttggctcgttatcaaggcgagacgttggcaattgacgggtatgcatggttacataggtcagcacactcatgcgctatggaacttgccatggaccagcctactgacaaatatttacaatttttcatcaagagaatttcaatgttaaggcatttcaagattactccattctttgtattcgatggtgattctattcaagtgaagaaagagactgagctgaagagggcagagaaacggaaagagaatagggagaaagcacatgcattgttcgaagctggagataggaggttggcttacgattatttccaaaaatgcgttagcatcaccccggatatggctaaatgtgtcattgagtatctgcaaatgaattcgataccgtatgtcgttgcaccttatgaagcagatgcccagatggtgtatttggaaaaacaggggttagtccaggggatcatttcggaggactctgatttattagtttttggatgcacaagattaattacgaagttaaatgataatgctgagtgcatagagattgatagacgtaactttgagaggttgaatgagggcaaattcccattaagcaaattgaccgaagatcaattgagatccttggtatgtctaagtggatgtgattatacatctggaatcccaaaagtaggtcttgtcacagcaatgaaatatgtggtgaagaaccgaaccatggagcaaatgatcatggcaattaagagggaggggaagcttagtgtaccacacaccttttgggaagagtatcaatatgcgaattttgcatttcaattccaacgggtttggtgtccactgaacgaaagactagtgacattgaatgctataccaaacgaactactgaataacgaaaagttattcaattgcataggccatgcgatccataaggaatggaagatcaaagatgtgatttttgattttgaagacgtagaccaccatttgcataaacggatcagtcttggagaactgaatccgtacgatttcaataaacctttagttaacagagagcataaattacgtttgaagtcacaatctgtcgtaatgacaattgataagttttgtaccgcaaagaccacagcaggtagtagtgcgaacagcaaatctatgaatgcgttcatagcacgtaagagccaatcactaaacaacggatcaggcatcatgagtaaattggagacagcactaaagaggagaaaacttagcggtcctgccaacgaacactcgacgaagaaagttgtaaatagtcaattcttcgctgctaagcgggaaccaaaagcggtgcctaaagtggagccaaagcctgaaccaggccttgcatattctgcagctttccactctgacacattttctgatgtgatgttgttagactcggatgaagagtcggagactcagactggagagcagcagaaaaaagagccgtctcagaaactgagtcaggaagacgtcgagacagaagtacccagcagtctggtacccagctctgaaccagactcatcgttcaatgaaaaggagaagaaggacgctctgtcaatggcagaagaagaatctgaagtcttgagcgaagttgaagaaaaggagaaaacagaggaagaagacttacaaaagaaacaggacaatcaaatactagcagcattgagaaacaaattcttgcataccggagggttaacagagaatatcgagacctcgaagaacagaccaaaggaaagagttccattgaaaaacgtaactaacattatgagagttacttctaccaagacaaaaatacccgaaatatcttcccaaccaatacccaagccaatacccacaccaagacctgcacgtagaaccatgtctggagccatgactgcgatgcaatcatcagtagctaggagtgaatccagtggattcagttccggatccacttctagcacaatatcgttatcccaatttgcatactcgaggaaatagaaaatgggaaataagaaaataggaaatagtaacgctccaccggtttccctaacgcctacatactgttgatacggttaatactgtaagtagctctatgttacaacggcttccatttaatgaaagagaacttccgatacatggaggaagccactatctagtagcctgcttatgtcatccggaaacttccccccaaatagtttttccggatacctccagaaaaatttgggcgcccaaaatcctctggaatcacaccatttttataaaatagaaatttacccagaaaacaccgcacaatcaccgtgacatgtcgtcccaggcactaacgatacaacaaaaaacgatcaagataccaagaataaagaaaggatctttccataaacaaggattacttgtgaacttttatcatcctttccatctatatatatgtatctgagagtgtatttctttcggataattgtttaaacattcgcagttagtcactttttggttgttgcttcgacagctataacgatttcggtgcagaataaacgaatataacaaacgcaatatgccgttcactcatagtgttaatttaggagctcccagctcattttccgaggtagatatgtttttgcagtcgttgactagcgaggaaagtagtgatgctgacagttatgacttcttttctcctgaatcgcaacagatgcgtcagagtttccaaagtacaggtacaaatggcaatggtaatataaatataaatggaaatggctacgtgaacggtcgttcgcagatggattcagttcctcaaggtgcgtttaatccgcagtatttgaatgctggtatgaaagctagagattcagatgatgtttctccttcttccgttggtgtgtcgggtatggcttccgtttccattggacaagtaccccaggatgtcagatctatgagaagttcaaatgggatttccagtcttgggacttctccccatggttacaatgaacagactttcattcctcagtcgctgccactggaccaggtgaattctgcgtcctttggatctacttcttcttcagaccactataataacaacagtccgttcgatttgagtgacacagaactaaaaccttccattacaaatgatacagacctggtgccccatgtgatgattaaatccgagagcgatagttggggcgaatacaatggccgtaacggtggtgttaatgctccgaatagaaatgaggctaaatctggttacttggtcgttgataataagctcggtccaattaatttgaccagtgccgctatatccggtgcagcagcggcagcagccgccgctgctgccactactaccaaccgtcctggttctactttcactggtaatgttggtagttcaagttcgtcttccgatataatgatgagaggagatatgggattacaaccatcgtcttcgccagcagaatcaaacgactccagatccagccacggcaccattggtgttggttcatatggtaatggtactagtgccaatgggaaagtaggtaaaccaaagaaggaaaggacttctcacaacgttattgagaagaagtaccgtaccaatatcaacaacaagattgttcagttgaaggaaatcattccctcgctttgtgttaccatgaagagagaagagggtatcccagtgactgaactcgaccatctaagattggacggtttacaacctgcaaagaaattgaacaaggcttctatcttagtgaagactatcgaatatatccaacatttggaaaatcacgtcgaaaggttgaaactagaaaatgaacagttgaaacaaggtcaaactttctctacacctttgtccgtacgcaacaattccacttcagaatcctcaaacggtcaccaatcctcttccgataccacacctcattatcattctggagccaacgtttccaacgcttatccaacagatgtcaacgcatccagttctttcaggaacaagatgttattagatggattggctatgactatgggtgctaactgtttcaatggtgattcaagcgatttccaaactgtaagaggtctaatggctatgccagtgttccactattccccaatgaatggcttcactgtcagtaacagtaacggtaatatcaacgtcttctcttcattcctatcgctcttcagattaggtgccttctttttcatcatcttttatttggtcactcaattgatcagcgaaaagcaatcaagcaagccacaagctaatgttgctgactttgttgttgactacgcggattctttgaaattcaattctaactccaatatcgtcgaaactttgaagaaaactctgttcatcaataagttgaaatacccagaaaactcgatggaaagacttgaaaacgaaatcatgaaatgtttcgctatcaagctttggaaatctccatttaagatccttgtttcaaatcaagtcgaaaaaacatggagttccttgactaagaaggtaaacgatattaacgaaaaatcaaaagatggtattgataaccaagactggaaggcaatcactaacattttggaggccagcatcgaagaaactttaggaaatgaaacgttgttgtcgaagttgacagagagtaaggatggattcaatctatccagctttgttcaatttgtaaacagctctatcattaatcaaaaggtcgaatctgtgatcaatgatgtcttcctagtttcttgcgaagatgatgaatctgccgtatctcaaattgatgacatttttaaggactccgtaaagggcaacaaagaatttgaatctttaggattgacgccaatactcgactgtattttccatccatcgaataatcatatcaaagagctcactgacaaactaaaagtagaaaaatcatctctagatgctgattctaaaaatgatatcgtcagaattctacattcctgcataatttcctcattaatctcagagaaaaaattctacgaagtgtcatattgggttaacagaatccctctatcattgcttgatgagaatctatcgatattatctgtgttctccctgtacatcgctatcaagaaagtactggataatcatgaaaacatcgaggacatcagtaagatcagtgccaaactcgaatacatcagtggtaagctaaggatctggattggttccaactccggaaataccctacagcttgacactagaggaaaattggtcgacttctttgtagatagtgcattgaagttcaactcacttgtcggtagtgacgatgaagaagacgaggaccatgatgatgacgaatatgacttagatgatgaggaagatggcgacttgtttgacgatgacgataacgaagaccttgaaactgatcaaacagaattaggtggtaaactgaattgaaggtgtgttactttacttttcaatcctttttacgacgaatcataaaggttgatgataacaataaaactaatgcagcttcttttgacgatcatataaagcctcttcctacttaatcaggagattaataactcaggaaaatcattgcaacatcagataccacacaatcaaagaattatgaattttgccatgaaaatcaaaacgtctgttaatattacaacgctgtagacttgcgtcttttaaaacattttatttcggagatcaagatcagttcaaacatccctcagatctccattttctcttcagcttcaacattattttctatttatttatatttcgtatgaggcgcacactttctagtatttaattcggagtcgggcaagttacaatttactattattcatgtatactattttgttataactataaaatcacactttcccatttgtaccacgattactatccatttataccatacatattcaaagcttctacttagtcaaagttactatcaatcgatttgtttcgaagacaatattattattagatggcatctacttaaaagagttttggataaataacagcaatgatacaaaagataataaaagggaaaagtaatctttaagtttaaggtattgaatgataaacaagccaggaaggagtagaaaagaagtatttgaatagaaaacttgagattaaatcataatatggaagaaaagggaactcagaataggaaaagaaagaaaaagaaggagaaggccatgtaataggaaatgcgtaaagaaagaatgaaaagaatgcagtttaaggtgtaattagactagaatcaattatcaaaatgacaccatttgctgccacgtccactgttttaactagtttgaagtccatgtttgaagctgacgcaacgaaatattcgttattctgtcttttcaacacaatgtcacccttttcagaggtgtctgcctcgctatgtaaccagatttcgtctgattccaaatcgaaatcatcagaatgtgccactatatgagatttcacaaagtgtgctacattctcttttatagcatcgtcgatttgttttggttctgcattcgattgttccatggcatcgatattatttgggaactgccaaggtttcatcgaaagttttgaaatggcatcgttcgttggtgcaatgacgattaactcttgcgatctgtcctcccattgggctacaacctcggtgacatcacggccatactcggagaataaactgatatcttgcaatatagcaagcctagaatctaaattcactctttcttccactttcccctgggtaatgtcgagcacaaactgtggtcttctcaggtctcttttcctaagcctaagctcagaatctgacagtccgtctacgttcaagccgatacgtctagcatcccttttatccatggcttcatcatgtccagccatgatgccttcaatatctaaaggtagtctcttaggttctctcttctcgttcttagaatcagaatcagatacatccaaagaatcgaggtttagtacccttctggcaaccaccttgtcaatagcacccaataatagtagagtagatagaatatttaatctcattgctttactatttaacttgaaaaatgttttgaagctcagcaatcgtaatatttccacttaaaggatcaaacagtcaccgtaatcaaaaataactaatgtctatgtttttaacagttgagactcgttacaagagtcagttgcagttccgattagtcttgtgtaatgctatatttaatctgaaaccagcaaagtcattcgattgtgagactgttttcaacttgtcacagggatatgcggaaagtgcgggtaatgaccatgcactaattagaaaaggaaaaaagaatgcatcggccgggaatcgaacccggggcccaacgatggcaacgttggattttaccactaaaccaccgatgcttgttggttgtaagagaagattctctccggaatcacattaacttcggtaagtcaggcggacaagatttcatagttctgctgattttgataccaatgttggtgttacgagttgagatgacatgacatgagctgaagtattagggtatctaatgtaattgtatgtcctctataagatactataaatgtgagtagagtttctactttcaatttgcatcgtgatcgtaaatgacgtttctcgttaacatagtgtcgacactttccgtgtcagaaacaattctatcagtaaactggggtttgtttgcgtttttgttcgccatatcttgtaaattgaaaaactctgatgatgattccgcatcgttattccgaaatgacccattcgaatggaatatgtttctatacgatttggatagacgaggccttttcgggagttttgtttcatttggagaagagaggtactgcttagtttcgccatagttgatcttcggatccacgaagaatctatcgttgttgttgatcttcctacccaacaacgatttcttggagactttctgttctctttcctccaattttccaatgagaccccaagcgttaacgaagatcaggattctgaggaaagcaatcacaaaatggatccaatggcttgaaggttcgccttgccttatttgtaaaatcgctaccacgtacagtaacatatacacggcaacgttgtatattagaagcggtattatttccttgtattcgtgaacaaacaaaagcagtcttctgaatatggacataccttgatggtccactgacgctgaggcagatttcaaactgtgataagaataccatatagtaaccaaaaggaaaagtgtgaaaagtgagagctgagatactctaaatactatcgagatggaagtttgagccctgttttccccttgaaataactgtattccgaaaaatattacgtgtaacaaacataggatcacgaccaaggacattatccaatgaactgcatttaaatctctgagccacctgggcatagaccgtctccaacgccgggatattcccctactccgagagcagagataatatatgacaatgatccaattcacattacaaaacaccaacgagaagaatcgtaccactttagaccatgtaacttccaatatcattttgtcaaatgccagagaatcttgatagttactaatatactgtatttcaaagacctcatcgttagtcttcttccaaatgaccgtttggactatggagaaatacaacacgtacaaatgcaccatacgtttctgcctgttatggtttgtagatggtagtaaaaataaaagtaagaataacatccaacctccgatgcatactccggatagaacgaaagcgatcacaaggttcccactgataaacacgtttttctgaggaacaaaactgaattccttggacaagtcagccaacgcatcgatgaatatcgacgtttcatcgctatccgtacagttcgcgtaccatgctggatagttcatggtctggttccagatatctgtatcattgatgagtgaattcaccgatcggaaactgccactgttcaacaagtacccctcacagttgaactgagacaccaacggttttaaccaactagtatcagccatcgctgtaccacctagcatgatggtaagatggggggtgttttgcttgaacttcttttctccttttgtacaatgtctatgttccggtgtgaatgtttaaatatactgtgccaagagttttcatgggaaagttcactttctaattagactcgaggaatagaaggaatcggaaaatattccgagtggcaaggagataaggctaatgaaggatatcctagtgatgtgaattacgccctacattactattatgaagtacgtccgttagttagacggtgcttcttacctaaccacatgaccagtcatatcaaccccattgaaaaaactgggaattccggcaataatggcacacgcatacacaataacataacaatataatgaaacaaatgtacataacaaatagaaaagaaagcaagagtgtattcaacgcttgactgaaacattcatgagctacctcgattcgggcattaagacttaccattatgccagggcacagcatatgacgtggaactggaacgatccagccaacgaggacgggagtaggttttcacttccagaccaagagagcgtgcgccaggacgcgcacgccggattgcaagtcaacgttggtgaaccaaactcctattgggactgctatgtggacgaagaccaatggcaagtgtttcaagacttgctcatggattgcaatggtaacttgactcgaaacgacgaagcagaaggaaatatcttcaggcacgtgatcaaaccacgtgacttggagcttcccttaccagtgtaaatgtgaactacacacacaggcacggatacaccgtacgttatttgacaaaaccgcacgtctttcctgttccacggtacgctcatttcgcaagatccagcgattttgctgattatcatggtgccttccttggtcttgccttgaactcttgcctgccttgccttgcctgtgacaaatcaaatgacgtcagcagagatcacatatcgagaccaaacattaatattaacatctaaactacaaaatagtagaaatcaaacatgaagagagcaaccagtcacatgcaataggtaaggttcttgatctggacttatcaatgtcaattgcaatcattgttgcttacaccagtcgcctgttcagcttcctacagcttttccacatgcagagcgcagctccctgtgttcggagagagacctcatttcttctttcttcctcactgggctcggaattttccctcacaaaatacttggaagactgcgtagcatttttattttaaaatggcaaatagcaaataaatttccatactgcacatagttaaagataaagcaagcccgatgatgtctgtaatgtgtgttacgtttgagtgttgctactctacatggatcgaaaaacggctttgctctggttaccgttgtaataaatagaaaaaattcgtcaaggaaaggagtggggtctgaaccggcgagtgctgcaagttcgtaacgtgctggatagtagtgttacgtcgtcgacggaaacatgaagcatgaaggatgaagcaaggacgaggctaacactacataaccttttaagggttcgtcaatccattcactattaactgtctggattgtgttatattcacatccgtaccaaaaatacaatattggtataagtaggtcagatgagtagctagtattatataaatacgaccggctttttcttttcattcctttgcttatttcacccgtgggttcaataatattctcttgcgttttttgtaccgataggcaccatcaccctcgtctgcttatacacttgattgttaaactgattctatcataatagtttacttattattacttttcacgattaatcctaaggtctagtcagagttctagcctcaaccaggaaataaagtcagttttatcaactctaataaagcaaggtcaactggataagaagctacaccctcatcgtcataacttatcctgttgccatcccaacaaaagtgatttttcgagcattctattcttatattcttcttctatttcgtcatcatagtcattttctcccgcagtagaaagatcgagcaagacctgaatttttttttttttttcaaggttttctctattttgatattttgacgttactttacttcttcctagtttcccttcctgcgattacaaatcatcgaccggatcaagaaccctaaatttagttaaagaattttgtggtgtcgataatatcatcagtggccttggttatcaatattcataaagcttaatcgatacgaatattgtgatactgtctgtctctgtgatttttaggctttttctaacgcacttattggaagaaaaagtatactcacaggataagagatgtcgatgaataactcgcagtcatcgttgttgaatttggccagtttggtccaagaagagtctaacaatagtggatccggaaatgtggaaaacggtactaggagctccgtcagtaataccgggtctaatttctctaatactccaagagccatgcaagatctttcattgcctcagttgaactacaatagtagcggcggaaccagcaacaccggtactaacttgaaaaataacaatggtaatgccaacaaccgaaatattaatagcagtcatcatcataataataataatatcaataataacaacaatgacggtaataataccgatgcacttaatgatagtgataggaattctgccactgaagggagtattagttctgggaacgacgcttctagcaacgataatagggatctcagtgttggttcaggatccacagcgaaccagaaagaaaatatgaacggtaagaccaacaatgaaaatggcaatacactcgatcaagaagataatggtgaactcaacgatgaagatgtcgaggataggatacgtgacactgcgaattcaacaggtaggagcacacccggtttcatgcaatatcctaaaagtaccatgtcgactgcgtcgttacagcgtatgaatattccggtcccgggaatcgatatgcccttggtaacaggggataactcgcctcaactttcacctatgaatatgaacaacctgaataacatgaatttagggaaccaccatagtttaggtaagattggtgcttcaccacttgtgaactcaacgcttgggaactccactacgccctctgtgaccactaccccggtcggggcagaactaggcggtactggtcgtatcaacacgaatggttctggtaacggtacgttgatgggcatgcagatgcctatgatgttgaacagcgggtctgattccaataccaatccaaatgcgaacgctaaacttacaaataattccaatggcggcggcggtgtcatgtacaacggcggtataccgggtctaaataacatgccaaacacggcttctcaaagaatgatgaacatgaaatccgaccttacggatctcccaatgaacccacctaatagtaataataccacaacctccaccaatactatcaacggtaccacgggtatcaactcttccacgacaaacgcaacaggtaaccagtcgtcacagacatcaggttcaaacccggcgtcgctactacaaaactccacgacattggctacttcgacgttacctacaatcacaatgataaatgacggcgaacgtctaaataccgaaggagaattaattggaaagtcgggaaaagcattgcgcaacaccaagcgtgctgcccagaacaggaacgctcagagagcattcagacagagaagagagaaatatatcaaggatcttgaattcaaggcaagagactacaacagaatagcagcagaacttgaaacttacaaggcagaaaacagaatgctcaagttccaactaggtcagtaccagcaaaagataaacctttgatgaatcactgcaccatcgctcttagttctaatgtaaatcttgtttgacaataattaactcttaacgcatacacgcattcccaatcacagttctcacatccgcagttttttcccttacgtatcactttttagtaagtaattgacctgacttcctacaagacattccaatttctatattcaaaccttttctccgttcctgcttggtactttgcttgtccatagtgaacacaagatccatataactccctgctttagttcctaatcacgtgccaaaattgaacgtcatgtgaccaaaattccatgtttttccagaattcgggagaaaacaacagaaagacctcggcggttgagacatttcgaagtatataagaacaagggagaattcagaaaaacaacaacagtaaagctcagcaagaggcatacagtcagatcaaccactgattcagttacgtttggtcagattgtttattaatagcagccttattcaaacaactacacagtttgcaggtgaaatagtgaatcaagaaattacaatcagagtggattaaataatgctaaggtctgctgaaaatttgaatcgtaagctaagtcggacgtcgctattaaagaacgttaaaatatatcaacctagtatatctgatgttgaacttggatgtacgtgccggtcttttagcagtttggttcaaaaaccaaaccaaactacagttggaataagccggggtaataaagttatatctggtttaaatattggtgctagaaggcccaatataagtagtataccgcccatttctactgcattcaatgtcgcttctgttcgtagctatgctaagaattataatttaaatttgaataaagatcaggagggtggagaatcagctttacaacagttcggtacgaatttaacggagttggctaaacaggggaaattagacccagtgattggtcgtgatcaggaaatatcgagagctatccaaattctttcgcgtagaaccaagaacaatccagtgttgatcggtagagccggtgtcggtaagactgcgttgattgatggtttagctcaaagaattgttgccaatgaagtgccagaatctttgaaagacaaagacttatacgctttggatttaagttcattggtcgctggtgctaagtaccgtggtgaattcgaggaaaggttgaagaacgttttggatgaaattgataagtccaatggtaagatcattgttttcatcgatgaagttcacatgttactaggcttgggtaagacagatggctctatggatgcttcgaatatcttgaaaccgcgtttggcaagagggttacgttgtatcagtgctaccacattggatgaattcaaaatcattgaaaaagaccctgccttgaccagaagatttcagcctatcatcttgaatgaaccttctgttcatgatacaatctcaatcttgagaggtctaaaggaaaagtatgaagtgcaccacggtgtaagaatcacagattcagccttagtttccgctgctgtgctatccaacagatacattaacgaccgtttcctcccagataaagctattgatttggtcgatgaagcatgtgctgttttacgtttgcaacacgagtcaaagcctgactccattcaagcaattgatcgggctgttatgacaatgcaaattgaattagaatccttgaagaaagaaactgatcccgtttctgttgaaagaagagaggaacttgaaaaggatttggaagtgaagaagaaagaattggagaggttgactgaaatttgggaaaccgaaaaatctgaattggattccatcaagactgccaaggaagatttagataagttgagaaccgaattggatatttgtcaaagagaaggtgattatgccaaggcttctgaactaagatatgccaagatccctgaattggaaagaaaagtagcactgaacagcaagaaggatactgaaaacaacttgttacatgactctgttacctctgatgacatttctaaagtcattgccaagatgacaggtattccaatggaaaccgttttgaaaggtgataaggacagattactatatatgcagaattcattaagagaaagagttgttggtcaagatgaagcaatcgatgctataagtgacgcagtgcgtttacaaagagctggattgaccagtgaaaagagacctattgctagtttcatgtttttgggacctactggtaccggtaagacagaattaactaaagctttggcagagtttttgtttgatgatgaatctaacgttatcagatttgatatgtctgaattccaggagaaacatacagtatcaagattaatcggtgcacctcccggttatgtgttaagtgaaagcggtggtcagttaactgaagccgtgagacgtaagccatatgctgttgtattatttgatgaattcgaaaaggctcatccagatgtttgtaaagtcttattgcaagtattggatgaaggtaaactaacagattctcaaggtcaccaagttgatttccgtaacaccattgttgttatgacatcgaacatcggccaagacattttgctgcatgataccgaattaggtgatgatggtaaggttagcaagaagactaagagaagcgtaattgaagctgttaaaaagaactatcctccagaatttgtcaatcgtattgatgatttgattgtctttaacagactatcaaaagaagttctccgttcaatcgtcgatattagactcaaggaaattcaagaaagattgaacgacaagcgtatgaccctaaatctaactgacgaagctaaggattggttaactgaaagaggttatgacccattgtacggtgctagacctttgaacagattgatccataaacaaatcctaaatccaatggctattcaattgctaaggggtcaattgagacacgaggagactgtaaatgtggttattgaagatagcaagttagtggttaaaccaaaccacgatcccgaatcaagtgaactcggaaatgacaagcaagctgatgttgagtaaatctcgttgaacacccgcaattgctaactctccagcgtaatgatcgatattcttgactttctgtgcgtttccactgaattcctaaattatgcacccttgttagaccgccccggtagtaattcgataataatattacggactgctttatggccaaatattaaacttttatacatgtaaatacgtaccaagatgatgcaatcaatatatgagacatggacttttaggcaaggtcagctcaattgacctctttacttttgatggcggctagaagatataaagccaaatgtgattaactatgcctatgaatattatatattagttacaaattgcgattaagtcgagttatcggttaaatttgctttttcttttagcttcattaattgtaactcagttaatctgataacctcttttaaattttgcttcttatgttccacagctttgtttaaaggaatagtactgtttatattgtaattgacatctaaattcggtccagattttttgtttagttccgagccgctgtgtgaatcaatccaattccatagatcatattcagaatcagaataaagtttactgaatggcttatttttattaccacgcctattccttccataatacgtttccatggcaggcagaacatagtactcctccccgtccataacaattgtactgggactaacgaaatgaggcgatgggcttctgtggaataaactcgaacagagtctagggacaaatatgattagtataagcagcactacagcagcagcagcaagaataataggaggtaagtcagcaactagatccttaacaataccatatatttcttggacagttgcatataatccgccattctgtacttctggttgttcccttgactttgatatggttttcctctttgacctggatctttcagttttccttctagatatcgttggtcttcttttcgttgttgacgacgcagaagaaagaatgtcttttatttcagctaccatatcctgaacgctagctttctgtccgtttatagatcctttttgtatagccgatttgatccaacttttcccagtccattcaatgttcgttgctgctaagacattggtggtgtttttttctccccaggagaagtagaatttggtatgcacttcgaatgaattaccagatgggatttctggtgtctttgatatttgttcaagtaccatacacgtgttaacatcatcagattcaatcttctcttcgatgtaacactttgcttgctttggaccaattgatcctggtagcggcttgacgtatgtgtactttctagtcttattctgaaatggtgggatatcagatatttcaatattcttttgcctttccaatattctcttcatgtatgaggtatcatctccgcatattaattggaagatggtaccaacaggagacttgaaacttattttatcgtcaataatttcatagccgcttgatttttcaaaagtgcattcggttggttcgtgttccttaggtcccaaacatggtagtgaagataaaacctcttcaatatcctttctgttatctggggagctgctcttacctttgttttcctcgatgatgtcttcaagttcctcgaaaagaattttcgtagaagattttattccgtcaaaggttcccttttcaacagccgctttgatccaactcttagcagaccagtccacgtaagtatacactttcaccttggttgaattgtcatcagcccaacagaataagaatattgttttaacaacgaaggaattacccgaaggtatatcgggagttttcgagacttgtgtgacctgcacgtaatttttgagatctaacttgtcgattgattcagtaatctcacagcgagttttacttggacctatactaccggaaattggtttagtgtacacgtattctctttttttggattggattatttcattaaatttggagatatcatagttgccttgagcttttaatattcgatcaaagtattggacatctgagccatagagtatatttatcactgtaccaagaggggcgttcaaaatggtctcccccatttctcgttcattttcttttggcgtgtagtcgggagtagtcggctcatgtttcgaaggacccaactgtgctgagctttgagaatttgaacttttggaaagtcctgagggtcttgcctcgtcagacacgctatttgtgctttcctcagagctacttgtcatatcatctggatttatgtcatcggtatcgtcgtcatcgtacgaatcactttcatcacggttaccataggaatcagtgatagatgtggaagtccggtcgttagtctgaacatcctcatcatcgtaatccatgcttgaagcttcactatcaagagtcagattctcatcattcatcagatcggcagatcccatagtacctcgtttaggcttgaagtttttattgattattgtttgattccatatatccataatttgatcaaatgtactgtcccttgatatgaaagatgcaaacaggaacttgtcatgtaaggtttgtatcgatatggcattaggaaataatacggcagtgttcttttgttcgatctgaactatctctttgaatggaactacaacagtcttcatccatcccaaaatattcgagtaaaagcaaatgtgtctatcagatatgtataacctaccttgaatgagaatatcttttgataaagcacaactgtaatccgctattaatctttcaattggagatactacggtgtctttaaagattgtatggaaatctgtattacgcttagcacttgcatattcaatgccttgaagttctggttcttcagtttttctctttattggaatgtccgaagttgacaggcgtgttggtcctccaggtggttgaacaatatcactggtcttggatatgctactcgctcttgtcatgtttctgcccgaaaatgaatttcttaggggtgctgtaaataatttcgtagctgcagcaggcgacaatgatctcatagttaaatctctcaacacttcggggcgtcttgacctaccgttcctcggcctagttttttcgaatgaaggactggcagaatttgtattgctgtccgtatttgcatcatcattaggcattgagagtggggacggagacgataccggtcgatctggttggtctgtggtaatcagcacacttggtgtatgaaagccggtggacttgagatcatctttgtccttttcaatggcatctaaagttagatttcccctcccaaaggtcgaaattgggggggcattatcttgctttactgatgtaaatttgactttatccatgaaagttcccacagaaccaatatcatcactgttattaccatcttgatcgctatcatcgtataacggcacggtagaagacggattagtcatttgttgagaaatggaagatgtagaggagtcgctggtattaagggtgtctagtgtcgtcgccttcttcagtaaataatcattattcgagctgggagcaagaaggaagtctaaatgattcagaaatgagcctgtatggttgtatggatcattacttgtatctgtaccaccaataccagaagtcagcaactgagttctatctccattggacggttcatcgtaaaggctgctactactcttcagtgaacttttgggtatcaaatggttagcagcgttatgtgcagccgatattagcgatgaaaagaggccggaatcagattcgtctggcttactctttacgggagtcgcactatcacttttcgaagacttgaatttggtgaacagagtcgttgatggtacgtcagatagagaagccttgctatcgcttacccgtaacctcgaacccaatggatcagtgttctcttcccttgtcattgcagtttgattgaaaccctcagtggaagacgtatcatttcctgcatttaatgaattctttctcggaagcctcgacaatgatgtagaaatcctcagcgacctcgatcttgacttttcgccagactgtctgctactacgaatcttgatgctttggatacctgaacccgtgcttgaaacattgttcttatcagaggcatgattcgcagatcctgctttatggtcactcccatccatcaaatacaccttatcatagctcgaattcgacgataatgcagatgcatcatcattgacattgggtttcagactcgtagaccgtagcacacgtgtattgccctgagactttggttgactcttgtccttatcctttttcttttccttgttcttcttcttgcgtttgtttaaatttagcaacgaactagtattcccgcttagcgatcttagtctggatttggtctcctcaccaatggtcaacgtcatcacaatcctacaccaagtataccagtaacaagggtcctatggtgcatctatcgatgcagttctgccttgaatagataaaaccagaagcaaaaagtttcaatttaaggtagcgcgttctttaaatattatatataggtacaaaaatgaaaaattatcggtgcagagacagaccttgaagctataaatgcgatatgaaagcgatccctgcgtttgcccatgactcaaattcactacttcaattaagatccgcttaacaagcaagtacttaaattattgattacatacgggaaatgagggaaattgctattttaaactgaagaggatgtagatacagaaagagaaaacaacaagaaaacttgtaagtttaacggtcttctgcccattcgttttcacgtcttatggcagcttcttcctctggagtgaaatcgttaacgatattgaaggtccttctgatttcttcaggtgttctgcccctaatcatctccgcaacaactttacatccagcatccaacaatggcttgatatttagatagttagctgctagaataatctcatataacatttcttggtccactttcaagaactcacggtcccatggatccacaggcgcagctttcctcgaatcgtcgtcatcttcatcggggaaattggaatccttgtgatgaacggcccattcgatcactttctgtaatactgacgacctcacattgggcacgggcatcactatttcatcgtcaccatcctcttcatcatcttcgtcatcgtcagcatcgttatcatcatgcaaatcgccactgttaagatcttgcaagtagttctttagtaaaagtgagcgttcagcgatcttcctgtcaacgacaaatctctctccctcaacactcactaaaacaacgttctggttttccttggacatgattttctggtactaaatagaacccacttggtaactctatggtgctaactaactacaaacaccaagctcctatccacttgcaaacattaactgagatgtataacatgttgattgacaacctgttgggaattcgattcttttcgttatttgaccttaaggaaaagaaaattatgatcacgtggccattaaagaaacaggaagagaaaccccgtagtgccagtgaaagagtaacgttaactatagaactatctacatacacggtatggagcgatttcagtacttgaatggagggccaagtaaggttttcatagaccgaagttactatatacgcatgcactgagatcgtcaagtgccgagatggagtgtagtttctgtaggaacttgttgttcattgatacgagtcccgctttcaacatttcgtttgtgcagtctttcgtggcgatagagaataatgcgatttgatatgaatttttggatatatcgactactttggtgtcgtcatcattcgatttaggtttcgatttgctgttgacattatcctcgatttgttccatgattgtgtggaatgtttcatcgattaaagactccaggacaatccatgttccaggtgattgtaggcatttgttggtctcttgtacaagttgttttagtaatagattatcctcgtatagtactttcaaagcatcttgttctaaagtttgttgaagaacaaatctctctaagttaggttcaggaagtagacatgaaatgaacatttcattcgattgtggctgttgaaagaattgcttgtttgtggtgacgaatatcttgcttatcttgccactgaactcatccattgtcatgatatctcttgggttcgaattttggaactcttctttcaccaattgttcaatgatactcttgtattgtaggtatccacggtttaataaccaccacgataaggataagaaagcttgttcgttaacgtatctcgatttttcagggttcgcagtggatgcaatgctccttgtgtccgtgtcaatagtaccatcgctgtttcttgggtcagctttttcactgggtaaattgttgctcttttcagtgatccaactagagaaccaagataagactgagtattgattagccttcttttccctttccttttccatggcagaattgatggcagtatccaaatactctcttcttgccaatatattcaattgcaatcgggttaaaagcatcaataatgatgtggtataggacaagataatgatcttggtgatagctttgagtttcaaatcgtcccaaagctcggccttggatttcgtagacgtttcagaaacgctagtggtatctgcagattgcggagatttcgctgacacactgggtgcaggcgtcatcgcactcattcctgaacttaagccctcattttccaactcattcccagctatttcacctttggaaagcttcttctgtaactttttcccctttagagcctctacaatagaatcaagatcgaaatccttagccaacactaacgtcattaccggcatcaattcataaagagtgtacaacgagtcctgctgagtttgtacaaacctccgtttgatctgttccttgacaaatcgttgctccgtcattttcaaatgctgcttgtacaaccatcttttactgaaatagaccgtaatagcgcatgtagcaaatagcgtagcaaacaaaacactagaaacaacgaacttctttctgtgtctctgaaccagagatcgattcccagtcatgatgaggggtaaaaaaataacttataacttagagcaatgtaattcttctattgattttccactacagccgttgtcagattgcgtgtagagctttcctagtgtcgttgtttgtcttgatactttattgatgttgatgtttacttgctagttagttattttaatgtttttcgaattttgtttccccctcaaagagcgacaaattcgacagatttaagagaaaacatataccaaagagatagaattgcgttgggtattgaacctctatggttctgcaactggtgccaacagatattttatagtgtatcattacagctttatcttttactatacatattatatgtgtatatgtgtataattggtcaaaaacgttcgcatgactcaaataaaagatggatcatatatgtgatgtgtcgaatctcaaacgaaaacgaagattacatccacctattggcgttgcatctcagtgagacgtttaagattggccaagttctccaggatctggccatctgagatcataattggggtttgcgtatcgttgcggaagtaatcttctgcacttgtatgtgctaaaggtggacagagtctgaatgaaccagaccgatccatttgatgttggaagggggaattttccgaatagaacgcagttctatcgagtttgactttgagatggttctgctgttcgtcgttcccgttcttttggtataggttctgtagaagcggttgcggtggctgtattccagcctgaagcgatgatgactcgtggttcaataggaaggatacgttcatctgtttagagttccgctgcaaaagctgatccatttctgtgacgactttctgcaaatttgatgccaaggttgaccatgattctgcatcgcttggcgagagcgagtgtgcttgctcacgatatttctcacgaacctgtcgtagctgtgtctctatattcgataagtcatcagcgaccattatctatgctgacgagaaacaaactaaagtacttcttgagctaggccagtgttgaaattaagtatactggcggagggtggatgttacttcaacagtccaaataggactactcgccctgtattgagtacaggttctccatatatgtggtatgaatgtgtgtaatgtcttgcgtttttttttttttttttggcaggcaaatatggaattttcgctggataaagaaatagaaatattactgaagtacttctacgtgcgaaacgcacgcagattattatgcgttttgttccattgcgaaaaattcgcagtattatgttattgatcgaaaattttgattcagtgaagaatacttcatctcggtattatacagcttcatctcatctcatctcatctcatctcatcgctgcctcagtcgacaacgacaagaacacggaccacatacaactaccagcatggaagatactaagaaaattaaaccatacatctcgtatctcaataaacaggtggaacaactcagtggtgagattaacaaactaacgagcaagtcattggacgaacaactgttgcttctgcaagatgaaaagaagaaacttgatctttcaaacaaatacgcatatgtattgagttcactatgcttttcatacatgaaagtcctcaatatcaaagacctgtcacctatcatggccgaattggcaaggtgtaagtcatatatggataaatctaaacagttagaagctaagaaagaatctgaagagaaggatgaggtggagcaagaagaacaagcaaaaagagttctacaatctgcgttgggaggtggcaaaatggaacctgctatcagtaaagtcaactttcaggggaaacatactaagttttcgacagaggcttccaccaccagcactgataaggatggactggcaaatcgagtagtagacggaacaaagaaatcaaaacagcaaaaacaatctggtaaagtatcgaagaaataattcatctgaaatatgtcctggcatgttcatccatgtattcctgggtcttattctggcattctatattaataattagcatcgcatttttcactgacataacaagttgtatagtataaatacactaaaattgggaaacaaaaagaaggaaattccagttggcaaacgtgaacaagaattaaccaaagatacaggtttcaagtggcaacagagagttacagagaccagtaaaaggattaaaagaagtacatttcaatagccatgatatctgacgaggatatttcaactttccaaggtgtttgcggtacagataacgatgaattgtcaagacatttccttgagatggccggaggcaatttggaaacagccatctcgttattctttgaacatggtggtgagagacagttgaacagcaattctggtaataataatgccggtgctggtgctggtgctaatacagggggttctggcggtctgagtggcgacgtagagtttgctgaagaattacaaagacaagcgtatcaggatgaagatcaatatagggctccggatcaggcaagacacgagacattggtggagacaaatgtgtttcctagtgtttatggtggtattggaggttcttttgaaccattgcgtaatgccagggatatgtttgacaattcaagaccttcaggaatttttaatcaacaattagacacagacctactacgttctggtagatctaacaactaccatcgggatgacgatgatgacgatagtgattctgcgtttactgatgaagaaaattatcccagtaatgaggatgagtacgaatacgtagaagaaaacgtcgtggaaatagacgacgatggtgaactacgggaatatacgaaatgggttaagaagccaaaaccaatgtcaaaggaaaccaggctagcattattgtttagacctccattcgatttaatggcaaaatacgatcttgacactgcaaggcaaaaagccaagaaaaggaataaatgggtaatgattaacatccaatgtgcagatattttccagtgccagatgcttaacagagatctttggtccaatgcaggtataaaatccttcataaaacaaaatttcatatttctgcaatatcaatatgaatcaagactagcatctgcctatgtacaacgttatgggttcaacgataaggaagattgtcctcatatcgccatcttggatccaataaccggggagaggttgaaattttggagccgtgaagtgccaactgtggaaaatttcagacaagagctagagatatttctagaggaattctcattagatcccactactactaatccacctgttaaggaacccactccaaagattgatcccagcactttaagtgaggaaaaacagcttgaattggccatacgagaatcgctaggcaaccagactcctactacctcggacgaaacaaatgagaaatctgatcaagtggaagaaaccgaagaaactgaagagcccgacggagcgcaatggaaactcttcgactcaatcaaaccaatagaacatgcagaacctgataacaaacctggaatcacaaccagaatacaagtacgatccggtgatggtaaaagactagtgagaaggttcgatgcaatgcatgatactgtcagaacgatatatgaggttatcaaatctcactggccggaatattcacaagaccaattcgtacttacgactcataccagagaaaatcttatcgagaagcttgacgagtcgataaacgatgcaggtttgaaaaatagctccattctacttgaaaagatctcggactgatttgcgtttcattgtttttacattaatatctaaccattcgtccagtatatctttagactcaaacaaaaatatacttatatacttatataactgtaaaaatataattcgaagaattatgtctcacaaagcattacctgaaggtgttttctgcctcctgtctctatatgtgtcagtatgcctcgtcaacttttttggtgctttttgttaaagtttacaaaattaagaatacacatcatgatttatatagtaagcagttcgggttcatgaacaggactaaaatgtttctcgaatgatattaagctttgtatcgtctggatagcggaaaccgagcatcagcatacttgtcgtatttaggatgaagctgtggggttatcaggcgttgtttttccttttatgtttggcatctaacgtcattggagaagctatcggtacagctacacataccaacaattgggccgtgttagtctctacctcaagattttggttcaactatagacacatggccaatgtcttgagtatgtatcgtacggtgaagaggttaggtattcctgattcccaaatcattttaatgttaagtgatgatgttgcttgcaacccaagaaaccttttccccggttctgtgttcaacaatgctgatagagctttggatctatacggtgagtctgtcgaagtggattatagagggtatgaagtcacagtggagaattttattagattattgactgatagatgggatgaagatcatcccaaatcaaagagattgatgaccgatgagaattccaatgttttcatttatttgactggacatggtggtgaagatttcttgaagttccaagatgcagaggagattgccagtcatgacatcgccgatgcattggctcaaatgcatgccaaaaaacgttataatgaattgttttttatgattgatacatgtcaagcgaacactatgttttcaaagttctattcgcccaatgtaattgctgttggatctagtgaactggacgaaagttcgtattctcaccattcagatgtcgaactcggtgttgctgtcgtcgatagattcacgtattacactttaggttttatggaagaaattgataagaactctacactgactttgcgtgatcttttcgattcgtacacatttgaaaaagtccattcacatgttggtgttaggacagatctatacccaagaaatctatctgatgtactaatcactgactttttcggtaacgttcaaaacttagttcctgatgacgaccgtgtcactgccggagccattaagaaaaatgaacaggattctgataacactttgctcaagctggccaaagcgaagcacgatgaattgacaaagcaaaaaaatgatacaaccattccacaagttacaaaatctaatctgataaataacgatgaagccattcatcaaggatcggttgaaacgtataatatcaagctagtaaaagtactgggtactcttctactacttctcatcccaagcttgttaaaatacttttcatacgcaaagacgaacaattcaaaactcacaaacttttctttatataacgagcacacagcattatagtctgttccaagtgcactgtactcagaataaaattaaataatggaacaacgacaacatttaatgtacgttaggtttaaccaaaccctaattcgcatctttctcaaagttaaaatagtaactcaataaaaaatatagacattggtagtggagtaaaactaagaaatgaaaaatgaaatataaacgattatatatattgcagttaatcttggtactgttgtaacattaaccagttattcttgtattgctctaaggaaccaaccacttcatcttgtttcgaacttgactttctgccggttctaatctttcctggcgagttgacccttccggctgaaaagaaatggggttcgtcatcttcgaaaaacacagcatcgttatcaatgaacacatcattcttctgcaagcttgtagaagcggctgaaagatatggattgtgaggtaagatgaaacggtcctgggcgtttaagccaccattaccgttgacattgacattgacaggtttcctatttccgaaactatttcttttcaacccgtttgtgtgttgacctggaactaaattgtcatggccaatgttgaaactttttctatgatgaggaggtacatacacacctgaaattcccttgtctgaacttgtggttggtcttcttgcggaatgcgccaaagtaacatgattgtttaacgggtcgtttatgtttacatgtgaaacctgaggcgatttgaataaatcaggtaatccatgtggaccttggttgttgttaccgtttgcagtaagattaacagaatgcgaggattgttgagtatttatagatagatcactcatatcattaatgaatccgtcgaaaccgtcactttcttccagagtaaacaaaacatcgtccagttccggttcattatcaacggataatgcatgctgttcatgatacgtcatggtatgaataggcggttgttcctcgtgctttgaggataaatgtggaattgatggtgacccgacatcgaatgactttctggaatgtggtgggacatatttgcggtttccagtattgtcttgattgaaggagccacgtctattgccgttatttgttgtgccgttcgtcttaggagatttcgaccactggttaaatctcttattctttttggagaaaaccccttccatgtaacggttatgtacactaggaggtgtaaaataatctctcgtgttgaagtcatcgacatcatctcttgacttgtactcatggaagaagttattaatatgagtgtttggcgttggaatcgccaatggctttctggaatttttgataatcttttcattgttgtttatttgaatcggtttgatattcgatttgtagtttttgtaaccaccagcaccgtacgcatcatgctttgcaggtgtattttttttggtatttttattgttttggtacccattactcttagagcggttatggctgcgcttagtaaaagtgaaccttggaacaggttctttattctgtttgactgatggttcgggagtgatttcttcaacagttatagcaggcggtttttgtggagtctgaccagtctcaccaactgctgagacagtacttatgataccagagaccgtggttgccacagtagctggggcagtagaatgcaatgggctcattggagccacagatggggcagatacgcttgttggagcagattttggcggtaaagctggaggtgggtagttgtaaaacactgactcttcatcgctgtctagtgagttgtaatattcatcatccatagtgtattcacttaatctttttatttcagttctgactttttccaaatttctgtttgtaggatcgatggtcaacgcgtgtctcaacacttggaagaaatcataactcatagtggaaaagacatcaaataaagcttccctattagcagcaaaatagcagaacgccttgtcagtttggttcgccacagtaaatggattcttatggaagacgatattcagcataacaataccgatggcccaaatatcaactttagcgcaatcgtaggcgtctgttctctcttctctatccagattagattcgaacagttcaggagccatatatctctcacttcctacatttctttccatggatgttttatcagtagtagccaaaccccaatcagtcaatttaatgttccaattgccagcaatcaaaatattctctggtttaatatcacgatggtaaatgcccctcgagtgcacgtattccacggcatctaagatttggttaatgatgtttgtcacatttttggtctttctggggaccatatcatctttgatggcctcgtacaaatcacctccagagcaatattccataataatgtaagagtcgaagaaatcgtataattccgtgatatttttatgcttcccgatcttggtttgaatatccacttcgtacaatgcctcgaaacatacgttgttagaaaatcttgacaaaaccttatccgaaattaaggacttttgatgtttcaacaaacgttgtttcttctcttgagacgagttaacagtgttgttagtttcatcatctttctcatctccaatgaccatgacaccatccttggtatcattacccttgtcatcttcactcttgaagatgtatttcactgctaccaacttcttcagttgggtatcagatgccaatgacacatatccgtatgatccttcactgatatcttcgatcaacttatatcgatcacgaagaagaccaccttccttataaacttcgtaatctaatgtcattttctacctgggaaagggggaggtttagtttatagctgtgacagctttgataagattaaaggtaaacacactttttcgagaatttgtgaggaggagtaaagtaatttgaaaggcgtttgtacaaacgaagaataccgactctagatgaaagtaatcactctctaaattatagttatgttttatctttacgaaaagcaagctgaaaaagtaaagctgccctgacttagcaagtcccttaatgagtcagtctaatactaataccaatgtcttcgagataaacaaggggaaattcttcctagaatgattgaaaaaacgtcaacaaaaaatatgccaaatgatggttgagttaaactcaggcgtaagcagattttatgataacaatacgaggggtctgtgtgttccggtgccacaacaacaataacaaaccactgggtttcttgaaaatcctttcacaagctggtatattgcgtatccttggagcctaacagttaaaaaagaaagccgactgaaaaagcactcctaaatacgtttattaagattgaaaaccctttgaacgttactggaaccgagaaagcttaacacagagtatactgaaataatctggttcgttcctcaactgaatcccactattcttcaacgagtctcttggcttcttaaataatcgaaaagcccgtaaaagaaaaaatgaaacacacgcaaacaagtaattaaagacaagaacaagaacaaaaccacagcgttgtttatcttattctctgtctttcctttagttctgaagctctttcttttctataacgatccttgaaaatctgtaaacgttggaaaagatcacaatcgtgtgaagcgacatgcgccttaagccctaacggagtggtctttcttgtcctagccgtggccgtttagacgattacttcttctggaagggctacatgggctagaatgcttaggacttcgtctctggggggtggtaaaacttgctcagtgaatttagcttggattctctaggtgtttgataaactcagtagcttttccaacatatatgaatgttatatgtgtcatgtgtgagatgggcaagattcgctggaagagtacctgcaaagtttggatacggtaatgtttgtgctgctactgctactgctgtacggcatttcgggaactcgagtatcgtttacagttcagatgtaagttctgtcccattattaagggattatcagcaggattgtattaataaatgtgtggatgcagtgactcagggcaagatgaggataggtgtctccttagccactggtggtgggaaaacggtcatattttccaatcttttggatagattcaggtcacttggtgcccattcgtcgcgtgctgctttaatcttggtgcatagacgggaattggctatgcaagccgcatctacgatatccaaatttatgcctgatttaaatgttcagatggagatgggaaaacttcatgctaacttggaggaggctgacgtagttatcggttcagtgctgactatggttcgaaggctggaagaataccctccggattctatcgatttgatcgttattgatgaagcacatcatgccgttgccgattcctacgtaaaggttttggcccatttcaatgcagatacaccagccacaagagtccctgtgattggatttagtgccacgttcgaaagagcagataagagggcattgtctgcagtaatggatgagatcatatatcataagggcatcttagagatgatcgacgagaactggctttgtgagggcaaatttactaccgttgacgtaggtgtggatttgtccaaggtaaagagcgttaactctgacttccaactagaggggctttcgaaagtcatgaatacaaaggaaatcaacgagattgtgttaaatacgtacctccacaagaagaagttgcataacttgaaatctacccttttgtttgcagtcgacgtagcgcattgtaagaccctttttcaaactttccagaacgcaggtatcaatgcgcaatatgtgactgggaagactaggactggtgaaagggattccattgtgtctgatttcaaaaatgggaaaattcaagtgcttatgaattgtggtatatttacggagggaacggacatacccaacgtcgattgcgttcttctttgtagacctacaaaatcacgttctttgttagttcaaatgattggtagagggcttaggaaacatcatagtaaagaacattgtcagatcattgactttgtatcgtcttcgaaagtaggtgtgatttctgtaccgacgcttgctggaattgatgattatgatgccaatctagatgagatggctatggatgagattaattccataagacaagagatagaggagaaaagattacagcaagaaatgatacaaagggaaacggaagctaaggaacaggaacaaaagaaccattataggaatattgtactcgacagtgactcaatcgaattgacattgacaaatttcgaggatttcaaatcgttttgtgagagcatgggaacaactgactattctaaattgtcacctgcagcgaaagaagccaggttgcttgcagactctaaattcccatgggtacctgtttctcgtacagcttggtgtttcccaatagtctctggaaggcacctaagaatagaaagagagtcaacggctgataaagaacggatttactcggctaagttgtacaatagaatatacgctgataaacaatcgggtcctgcatatgtaccctatcggattgttaacatacacacatcgaccgatcttgaaaccatttttaatactgtcgaagctttcgtatctaagatgtctgcaaatactccaatgagctttagcaagtttgcaccttggaggaaacaatctgctagtccgaaacaaaaggcagttgtcaggcgactttttgataaagttatccgcacagaagagaaatatgcagatatggaggccaatgtagaagcatatctaaaaaccctagacaagggagccgcatcatctattctttttgcgacttcacttgctccaaagtatccagtgaagagaatattaaaactactatcgtggagacaagctcaaaagattcgtaacgaagacgtgtaaataactattaatttataatttgtatgaaaataatccccgaaaataagttgtaatactgctaaagaagctgataaccaagtcaaatcacagatcactttgctttctcttgtgcctgtatacgcaatccttctatttactatttgccgtttcatgtactgtattgatattgggaaaaagatattgcaagtaaaaatgaatcgattgatcaaaagagagaacgtgagagaataaatcccgataggcaggtatgttactcggtaagaaactcagagactaaatcattgagatggtatctatactagccgtaccggggccattgaagacttttttcgataaattcccgttgaaaacattcgaatatgttaatgacgaagataaagctatggactaccaaatctcgcaacggagcgcatattttgaaggtccagacgctgtacaatcgagcaaagacgatgttttccaattaggagtataccaaatagtacgagactcagaaactggggtcctcttggcgtctgatccatggggtttatttgccgaattatctctcagcaagaagaacaacctaaaattacccagtgaaggatttaatgccaatggtaccaatgctccaacgaaaagacgattacagcattccatgtgtgtcctatcgcccagagcgtcagtgactaagagcttgcccattctagtggaaggatttacgaagagacacgttagatccaccgaaagcatcaacgagattttgtattcaagaatcgctactggtgaacacacaatgtacttgaaactaataaatacaatagtttacgatggttacatcgtagacttactttgcaacgtcccttctaacaagttttgcgagttatacgcccacatcaatgaaagagagacttccatcaccaattgggtaacaattcaggacactaagactactatccttgaaaggaatggcttccaaatacgccatgaagtactatctaaatacttggtcgagttgaaatatccgataaggacacctagagtcacccagttagcagaattatctgaaaatatcattctagagaccatcaattgtcttgaaaggttacaaacgcactggaaaggctcatcaaagtcagaacccgattcgactacaaacctcaacaaataccaatatatcgacttggctttggtaagctatatcttagccattgctcaattgggatctgaatcagttctcaaccaatggttacaaactaacggacaatatctattacagtactcttaccaattgctcaagaaatgtagttgaggttttaatcaaaaaaaattggtaaaccgactaaataaatcctagtgcactgactatgtatagcgttttcgatatatccgagacctttaaaacctcaattggataaatcttaacacggaatcggatggtaaatatcattgacaacgctgttaatatattaaaccggttctatcaattatgaggttaccttaaatatttgacatgtttcaggtgtgggacaacctgaaacaataacacagagaacgcggaaaccccgtttcggtaataagaatgtgctattttaacttgaaacattattacccggagtagtatccatatgtttcatgttgatgtcacagcaaaaaaatgtaacgataccatcgtggggagtgctgtttcaggctaatccgagctgaaacaagttgtggtttcaatccagttttgaatttataaggaatgaattaaagcgcattcttgaagtgatgccctttcttgaaaaccagtatacaattacttgttgtgctttttttgtttgttttgtattattagcatattgttcttgatcggtgcttagctaagaggatcacaaatccaattgatatatggttagatcaacaaaataaacgttcaaactttgaataaccaattttaattaatcaagatcaatttcactgaataactgaccgtggtttatttgtctcgcccaattcatacaaagtctgtttcatccatactgaaaggaaaaacagaattaggtcgctaggctgaacaattgaaagaagaaaagagaccaatcagccattacgggctataaggtccgaagggaaactgagatttacaatcgcaacagaattaacgataggtttggctgaaaaagaagaagagcattcggtcatttgatattgatattttcaaactggtttttaagaatacttgtgattgaatatagctaattggaatactaattgatactctcgaagaggtttcgctcattattataaggttttagtggttctttctataacctgaaaaactaaaagttaattagactgaaaaaaagagactggatctcaacattaacactatgacaggatcgattgtaaagactgaagatatcagttccatctctggtagaggggacacgagtcaatcgccggaagaagtggaggaatctctcaggctcattgaagatctcaaattttttctagcgacagctcccgccaattggcaagaaaatcaagtaatcaggcggtattatttgagtaatgacgaaggatttgtatcgtgtgtgttttggaacaatttatactatattacagggacagatatcgtcaggtgctgcgcatataggatgcagaaatttggtagagagattgtagaaaggaaaaaatttgaagaaggtatcttttcagatctacgaaacttgaaatgtggcattgatgcaactcttgagaaacctaaatcggacttacttgcattcctatataagaacatgtgtctgaagacacaaaagaagcagaaggttttcttttggttcagtgtaccacatgacagattatttgcagatgcactggaaagagatttgaaacggtcatctactggttctcagcctactactagggctgtaagcgaacccgctttatcgttcagatgggaagctaactcagatgtatcgctatacgatcaaatcactaatcatgtagattctcaaaggacagattcaaggccgtcgacggttggtgcgcaggatgtgacgcaaaagcagaacaatcgtgtcactgacactccggtaagtgcttctaaggacgtagaaccatttgaatctaatgttgtcgaggatgaagtccaaatagtagataacaacaagatgtgttacgggctgccgcattcagagtcgaacaactatgtgcctcaacaactaattgtgcctcagtctgatcttgaaaggaacgaactcacaaatgaattcgatgaattgaacgcagatttgaaaccgagcgatattcttacttccaaccaagaagatgatgatttcccattggattacttcccagtagagatagaatactcacaaacaagtatggatagttccttacacatggcctcgcaaggcgctaagcatcctagtcaaatgatgttctacgaagatatggacggaatgatgctgggccccaaatacccaatctctgctggtatatatgaagatccttttttccgtgaagaaatggcagcttcaaacgcctctaaatatatgatgccaccgccaatgtcagctactagggcgcactttatgacaaacggagaatattactccaagagtagagagggtaaaaagcatgggaaatcgggtaggcaacatggacctgatgatggcagaagggactacgataatgaaaacgttggttcctccccatctgaaaaccaaaatcctaatgaagaactcgatgctactgaaaataatcaagatgccgatgacaatcgttcacctgatatttacccgccaactgatgcaatggcaaatgacgaatatataccagcttacaatagaaggatgcaaatgagtgaatctcttgtgcatccgtacactggaatgatgctgaacccttacatgttctgtaatatgttagcggttgatccatcgttaaacatgggagtcaatccggtagtagatcccttttatggacagaatcatagcatggatgtggcccacgatgtatattctcctcaggaggttgtttatccttctaactacagatctactccaaaggccgcttacttcaatatgagatcgccttacggtaggaatttcccaccaccctcagcaatgaacccatattacactccgtatcatcgcagacaaccctcttctgcaacaagaaggtatttcagtaaggcaaatcttatcaacaggaaatccaagtctccgccaagaaagaatgtggtttccaaaccatctcacaaagctcctaaaaaagtcaatagaactagacacgctacttctatgcacgttggcctcggtggaaaggattcaggaaacacttcttcagaatctcgtgatgactcgacaaaggaggactctaattaaagcattaatttctgctagcagaatctttaaacctcgcaccttagaggctattcatgtaacattttcaacaattatttaatagacttcataatgacacttttttatttcaccgcaacgctgatcttatttgattgaaaagaatatcttctgctatagcaaacagttaaagttattgcagagcaaaagtacaatatcctagtactgctatatacactttacctatcctcccgctttgcacgtctgttgaggtcaactgacaataataattattacccggcaataagttgaacagaattaaattgttggttagtattagatgtcacctcatcgctaagtcttgaataagacataaatgttcaacctgcgttctttataagaagattttcctgtgagcgctatccccgaagattcgccgagagatatcgcatgtttattgactcagagtattcgtcatttttaatcataaatgtcacatttttcgcggtgaaactattgcagtttggattagtttggttagcaccaagaacgtttgatacatcaacacatttatttctcgaacattatgggataacctcgaatccatggtggggtaaacttctttcttgggattctatcttctttctgaagacatctttatggatgagaaattctggatattctgcaccacaatatgaacatgaatgggccttttcgccaatctggtcaattatcattcaatcctcagatcttcagcatatagtactcaaagccgtatcgtttaaccttctgcttcattatttatccacctggatagtatatgcccttaccaagctaacgtttcctccatttgggcaaaatgtacaaacaaagttggctctaacgacatcagttttattcatcctgtcaagcgcggcaggattcctgatttcagtttactctgaacccattgcattcacattttccctcttgggtatgcttttcagacaatggtctattagcttcgatgtttacgggaatctacacatggataaactaaaatggatatcttacctattgtcatctttctgtttcgctttcgcatttctcaacagatccaattgtctcttattagggctattttatgttcatgactgtctaaaccttttcaaacagaagaaatggattaccagtattttctaccccattctttctggaaccattttatttggtgtcttcgtgtatttccattattattttccatatgctgcgctatgtcctgaaagaggagaatggtgtaacagtaaaatttacggtcttcctatcccgtatcaatcattgtattcatatattcaatctaagcattggaatgttgggttcctaaaatattggactcctaataatatacctaacttcctgtttggtcttccaaacatcgtcattacttggaatgcaataacatatttttcatatcaatacccttctcgaaatatgaaaccatacatatggatagcacggatattcctttttataatggtgttccttgcaaatgtccagattattaacagagtgtcttcatttttaccgctctctttatggtatatttcagattcattgattaagaatccccatgaaatgagaatagtaaaatattatgtcatgtggctgttgatatggattcctactcaaaccgcactattcgcatgtttcctacctccagcatagttcgatgataatttcatctttgcatttggcattttctatagccattggtcaaaatactggaatgtcattgtatatacatgaaaatatttaccttcatttaatcattatataagtcattaaaaaaagattacggcgtccgaaatggttaggaaaattgcgctcaattcaacagacctcctgtgtgattgtggcacttaatgcaattgtaatttcgtttgttttgttttttatcggccttgccttggtgtaactattttaccataattggtgcaaacttcctttgctcttatagcgaaattgcttgacatgtctgtcactgaagtattacgtacttctaaatcatttgcgtctcgttaaaacactattagtcaaaaattctagagctgaacgggcatcgctattaggcaatccattgcgtaagttctgtaatgctttattgcagtaatctttagcaagttcatttgttttgcccacaccgtcatactttttcacagccaatgcagcagcctcaacgtcaccagggttagagaagtttcttttgatcaaaggaccaagagatgggtcctctctccatgcgaaaagtacaggggccgttgcaatacccagttctaaatcagcaccggctggtttccccaaatccttagcggaaatcgtgaaatctaacatatcatcgaccagttggaaacaaatacccaaattcttcccaaactcataacactcttcaatgattggatcacgaacaccagataagactgcagcagctctacaagattttgagataagagccgcagttttcaaataagtcttgtgcaagtaataatcgaatgccatatcaactaattgatcatgtgacagttgagtcccattggttgtactagaagttggtaccctgtattcatgttcagttagttcaaacttggttggtggtggtggaatatgttgtgtgccattgttgaaagtggtgtgatcggcatcgattgcggtattcttcaattgcataaattcaccttcaaccaagttggcaatactgttggagactagttcgacgacttctggatttctcaatctagaaattgctacagtggctctgcctaacatgaaatcacctgctaacacggccatcttatttgtgaatgcgatgtttccacttggtctaccacgtcttgtgtccgaatggtcaatgacatcgtcatgaagcaaagatgcagtatgaatcatttccacaatttctgcaagtcttctctgttttggaaggatgccccttgctctatcaaactcttggggcaatggttccggacccttagttagtggattcaatggtttaatgccatgtagaatatgcaatggagaaatgcttgccggtacgttttcgaaaagtcgagagtgttgcactttagaatatacgggatcttccggaacatctgtgtaatcaatcttgatgcgatctctttcttccagtggaatctgcgatagtgctcttgagagtaataaaacaagcataggtctaacttttttaccttctgcctcaaagtagtaacctgaaattcggtttagcaatggatggcctgaaccaattagtgtaactatgtttttcgccaatgtgttcatttcatttgatactaatgatactgggttattcaacaatgcctttggagttaccaatctagccgcagtgttcaaagcagttgcaaaagaagatttgtatctatatgaaagtaacgaagaaacttcgccctttgataaagaccttctgacagcagcagatctcaacatcgtgtaattatgggttagaattttgtcaattcaaaggaagaaatacgaaaccaaaaccaaatacaacagacttaggaataacaaaacctaaaaaatgcctgtaatataaatgtactatcggtaaaattcagcgataaagtgagcaatctcgagacagttgagtggttggacaaactgaaagtaaataatatgagtgagattcagccaatatcgatgtgaataaattaaattaattgctaacggtattaaattgcacgaaagagaaaaaaaacctgccgtttcctggtagcgatctcacagtatacaatcgtaaacgaaaggaagaagcgtatgctgcaatgcaaaagagccaagttggattgatgagtaccactcactgttagtcttatgtttctcaaagtttcctattctttttcctaaacctcagtttcgattttttttcctaaagcttcaacatcttttccctacttgacacggtattggctaaacatgaaaagatgaaaaaactaaagaaaaagaggaaatcgatgagtttatgtgttaaacgaatgaactaattcaatgaaaacgggatgtttataggtgctaaaatattcgcatactagctgtactaattgcggaagatcacgggtaatcgtatacttttttgtttactcataagctttagagggaacttttcttttcatcggtttgttctttgggctaaataaccaaacctaatccagtggcataataagtcccttccaagtaatacacttattgcatcagaaggcgaattgctctaatattttttttgaaacctgaaatccttagtcacaggtattagaaactatgagtgattcgggcagttttcctggttataaccagtttttagagatggtgaagacaactttggcgaaagtgataagaagttcggacaaagtaccgcaacatgtagcgttcattatggatggtaaccgtaggtttgctaagaagaataacatggaggtcaatgagggacataatgctggatttgaaagtatgtgtcgtatccttgaattgtgttatgaatcagggatgaaagttgctacagtatttgcgttctcgatagagaattttaagaggagtacgtttgaagtgaactggctgatggaattggcaaaggataagattaagcagatatctcagcatggagaattagcggagcaatatggtattaaagttcaaatcattggagataggtcgttattaccggctgacgttttgaaagaagtggagttagcggaagaaattactatgaataattcaagggcagtattgaacatatgcttcccatatacagggagagaagagatcgtgcattcaatacagggaataatgaaagaaacggccatgggggaaattgattatagagacattgacgaacaaacgatagaggatcatttatatacacagggtcagccacctgtggagcttttgataagaacaagtggagtcaccaggctcagcgattttttgctatggcaactaagtaacagaggatgtaccattgagctggtagattgtctctggccggagttcacgccatttagcatgcttaaaatattgataaaatttgcatttaagaagacatactccccctctaatgaagaagacgatgagttaaaaaagaaaaaataaaatgactgttgagatctggagcttttcacctcactaatacttacattaacattaatctgcatacttttcaactatacaagtaaccttgaagggatatacttagtttgattgtcatcacacaaatttttttttgatttattatatcccaattggatttgcattagacgttcgttcaacaccaacttaaatagcgtaccaaatataaaacacaggcccgacgatagtctcactcactacactacccttgggcctcactgattccttttaacttggggttgtattaacaatttatatatgaatatataacatcattatacgtgtatttgctattatttggataaatgggaagagagaggcaaaagcttatataaaagcccacgctaatccttcttgttgacattttgagccttttcgaactcctctttaaatttgtcggcgttttccttgttaccgaatctgatagcgaaggtgaacgcttctggttggccttcagcaatgtccgcagtacaagtgtaaacccaggatctatcagaaccaacatttggcttcaagacgtattctggggcgattatatggttagcacataccttcaaggtcttgtctcttctcatcaaaagtctgaccttcttagtttccttgtgttgcaagaacttaacatcaccagtacctctttctttccattctttagcttcaccatcaaatctaaatagcttggctctgaccttgaatagaacctcctcgttttcttcgttagtcttcacgtcaactttttccaacgtaacgactggctcaaagtgcacgtcaggggactctggagcatcctcttcgtcctttcctgtcgtttcagtttcagccttgccagattcttcttcttccttcttcacttctggttcttccttcttcacttctggtttcttaccaccaaacatagaaaatacagaggcagttggtggtttaggaacattttcagtattcttattctcttcagacattttttaacttaatatatggtactgatattcgtgagagatcaacgtattccactgaacttttgttgttataattaataactggaaactaattgacaaccggtacaagaaattcgtagacttgtatcaaatgcttctaattttggaagaaaacttggacaaggatatgaatatacatttgtataattatcaacaattaaccaaaagactatcatctattaaagctttatttcggaataagcttcaaaacttttgaacaattttttttggtttgataatatgtccgggtaactatttcattaacgcttgtttcaagttgggtaaactttggcttattgaatatgttagtggaagattcattggagttatgtcatgtgaagagtatcctaattgattcctcgggttttgatcagcgtcatagaatagattctatattttttttctatcagaacataaccatcgcagctgtttcaatttctaaacgaaaggcaaagctcgattatcaaaagaaccgtccggtgataaaatgtgtgagaatcaataccacatctaacaagtttaaaatttgtgcatcgaaaagtaattaccagcaggatacctggggatctgtttggtatccccgttgtcaattgactacgtcttggctactcgatactcatcaggtgttgcattgcaaaagtccgcagatcatccgaactctgcagaaacctgcgtagcggtgatgtcgaagtttatccgtaattataaagaaacaagaagagaggattcctgtatattggaaaggatcaaaaggaaagagatgaaaagaaaagcttcataaagcatagaaagaaaaaaaaaaagggaaaggacaattaaagaaacgtctaccttgttatttatccgattcaaggtattgtgtatatatacacggaccttcctcacttagttttatcttcaaacagtgaagtgtccaagtcagagcttctgtttcacttgagtgcattaggacagaaactagcaatctattcataagcattctgtgtgaatcgcaactgaataatatattttactaattgcacaaacgttgaaggtaccctttagcgaaggattgatatcatttaatccctaaagataatatagggaaaactggatatcttttcagtataatatacgggcgtcagcgacacgctttatcctggcagtgcaatagatcatacataatggatggcaaagtaaataataacccaccacgttctagacatagaagaacttcttcattagaagaagtagtggatcctttttccactcctgatgtgtattatgggccaaaaagtgatccttcaaagcttttgagcaaaaataggtttacccgtactagaacatttagtgttgcggaacccggtggtggtaagggacattcttcgtcttatacttccccttatttcgatactacagtgcctctacggcgtagaggctctgaagacgattcgtatagtgcaagtcaaggtcagagaagattttacatcgaggatgtggataagacgctaaaggagttgttagccagtgaggataccgatgggaactaccaaattactatagaggatactggtccaaaagttatcagggttggtactgtaaattcgaacggttacaagcatgtgcatattaggggtacctatatgctttcaaaccttttgcaagagttgactttagccaaacttttcaataggaaacaggttatcttggatgaggcaagattgaatgaaaatccagttaacaggatgacaagactgattagtggtcaattttggaaatcattgacaagaagaattgactctaacaatatcgcaaagattgcgtacgacaccaagatcgatacaccaaaggcgaaaaaccctagaatctatgtcccatacaattgccaagatgaatatcaacaattggtccaatggtctgaaatggacccatcgttacaacttgaagtcaattatttgccaaaggacattactcctgaatttgtgaaatccctaaatgataaaccggggcttttatgtttggcaatggaatcgcatatggatccagtcactggtgaggaaacgtgggttgggtttccttatgcggttcctggtggtcgttttaatgaactttatgggtgggattcctatttcatggcattaggtctcttagagagtaacaaattggatgttgccagaggtatggttgaacacttcatcttcgaaattgatcactatgggaaaatcttgaatgctaacagatcgtactatttatgtagatcacagccacccttcctaacagatatggcactacaggtgtgtaggaagatgggtggagataaaaacccggtagctgttgatctattgagaagggcctttaaagcggctatcaaagaatatttaactgtttggacggctagtccaagactagatgaaaagacaggtctttcgtgttatcatcctgatggtattggtattccaccagagacagagcctggtcactttgactccattttgaggaaatatgctgaaaaatacaatgtctccatacctgaattcagagatctttacaattcacagaaggttcacgaaccagatttggatgttttcttcttacatgatcgtggtgtaagagaaagtggtcatgacaccacgtataggtttgaaaatgtttgtgcttatctagccacgattgatttgaattcgttgttatataagtatgaagtggacattgcctatgttatcaagaaatactttggggataatttcgaaggattgccagaaggtcatagaacttctaacgactgggagaagttggctgaagttagaaaggaaagaattgacaaatatctatgggatgaagaaactggtttctactacgactataatgtaaagactgagaaaagaacgagttatgaatcagttacaacattctgggccctttgggcggggatgtcttcacaggagcaagcacaaagaatggttgagaatgccttgccaaaacttgaggagttcggtggattggtagcatgtactgcgcgctcccgtggtgagctcagtttggatagaccaacaagacagtgggactatccattcggttgggctccacatcagatattggtttgggatggtctagtccgttatggttatgaaaatcacactagacgccttgcttatagatggttgttcttaatgacaaaagcattcgtcgattataacgggattgtcgttgaaaaatacgacgtcacaaggggtacagaccctcacagagttgatgctgaatatggtaatcaaggtgcagactttaaaggtgttgctactgagggcttcggatgggtgaattcaagttacctgttaggaatgaagtatatgaataattttgccagaagggcattaggtacttgcgtcactccaaaagtattctttggaagactaccaccaaaagaaaagaagaaatatggtttagaatgaggtttccattttccttttcaacccatcaactcacttcattcacagatgtatagagatattcttaatttatcatatcatatattataagtttcacttgtttgtaatcgtgattgcactctgtacggaattcacatcggcatggctcctgaaatcccgtttgaatgcaaacagaacgtcagatgctgatattaacgttgttataaccaagtttttcgtcacgaaacaggctgacagttcaagacactcaagagactttgtgtcagcggtgtataatttgcagagtcaatgtatgatcaaacaaatactgccagttgcagaggcaactgttcacatttcaagagatagttacttgttagtttacttgcagtttctcattcagtaatgttacatatggataatggctgttccatgatctgaaatgactgatgaaaagccagaggaggtgacccatgcaaaaactatttcaggccgagatagaagtaatctgatcactggtaaattggaaaaacaaccgcttactgatggtgaaaggaaacgggatagaattagagcacatttaagacgacgaaatgataaaatagcttcaacatttctagacatgcaacagaaattgtttgaagatatggatcatatcaaaacccatttacacaacaaaaaattggagttcaagatttctaccaaggaaacattgaaaaggtggaaaggtgaagaagcttctattcatggacctatcaccttagaaattgcctctgatgtggaaagcagttttataaaaaaggcagactgtgacactttcacagtcagctattttccaacaaataatggctggcgacagtatacccaaaacaggactcatgccgaagaaagagtaatgaacaatagtattttcaaaactgacgaaaccaggattgaccatacagatcacagtgtttcagctgattatccacatctgaaatcttcattaaaagacgaatctgtcgaatatttttcaaatgatcaatctttcgttcgatatattgatgccaggttcgattcagaaagtataggatctacaaattcgtcagagaaacaaactctctgttcttcaatcaacacaagcaaaatcatttatccaagtatggctggagctcagtttgatggtgatccaatgcctcttttagatcatccgaatttgacacacttcagtggttttttggctgaaaatgattctgttgaaccttctcttgaaaatgacaaggacatgcagacagaaaacttgtctaatacgatcaattcatctgacactacgaagaaattcttagcttgggaatataaggatgataaatttgttaaagtaccgtgtacccctccaaatgaagataacgttgaatgggacattgatcactgtcattactacaaacaattctcactaaaggaaaagttgaaaaaaaaacggttacgcgcagcggagaagatgtactcctgggtgagacataactacttaaaggactccgtctcatattaaagtgattaagtgcataatactgattatcagtaaatattctatttttcttattggaaattaagttatccatcgtaattaaagcaaagttatatacaaaatctcaattgacttcattactgatatcctctgtgctcaatagaatttcaacagcagatgcattcaatttggagaaggtaaacaggcagcatagtatcctggctgtattatttgtataatttgttattttagataataaatgtcattttgaagctttaaaaaataaaatagtttggcatagcacctttatgaattgattcctaataaaaactgatttcaaaaataaccaatgccagtgactaactgtaacaaattgttagaataaaagaaaacaaaccattaacaatttggcatcattcggcagtaattttcaagtctttggagaaattttatttactgttataaatactgacgttcttctttattttaccttcattcagttttttgatggattttcatcatcatatcatatgccttaaaattaaaaataaaggtttaaaaaccgcaatgttgcaaagacaaccttcaacaacgtgatccccttatatcatctcaaatagaaggctaagagtaactaagccccaacaatgccatcaatccctacattagctgatgtgtgtatggtacctgtatgttgaatactagaactactatcatcgccactttatattctatttttttttactaacgcattcactattctatatgaacttatgattgcaacatatcatacgttcttggataaacgtaaacagctcggtaccggatctccaagtgtttctgactttgtcactaagatcgaaaagaagatcagagaatctccattgaaaagcactctacacagtgcaggcactactattgagggtccatgggatgatgttatgaaattgatcggtgaacttcatgaatatagtcatgaattagggtacgttagggttcatactgatatcagggttggaacccgtaccgataaagtccaaactgcagaagacaaggtcaatgctgttctgtccaagttggatcaatgatgggattttttttaatagtatagtaagttttctctaatattcatctattgtatttagagacgtttttctaatgaactggaatatatttttaaatttaaattacaatttaagtttacttagtctacacggtatttgggtaatataggcccataggaaacccccgtaagcctttgatctaataatacaatttcccattaaaatggaaagataaaaaaaattgatgtgaagttaaatttgtaaatccgaagcctaataaaaacaaagcatcttttgatagtttgtttaagcttgagtggaggaagagtacttggtaacagctctagtaccttcagaaacagcgtgcttagccaattcacctggcaagatcaatctaacagcagtttgaatttctctagcagagatggtagacttcttgttgtaagcagccaacttggacgattcggtagcaattctttcaaagatatcgttaacgaaagagttcaagatagacatagacttttgggaaataccagtgtctggatgggtttgcttcaaaaccttgtagatgtaagaagagtaagtttcctttctagccttggttctcttctttgatggatcaacagaagaagaagtcttcttggcagcaggtttcttttcggcaggagccttggaagcaggtttcttttcagcttttggagccattgttaatgtgtatggtttggttatgtgttggaggttgtgtttaagaaaaagattaaacaagagagagaaggagaaagagactaaagatagataaaatagaatatacagaaaatcgaaagggaagtgaattccataaactaacaagaacacaaataattacatagattaatctttcagccaaaactgggccaattgccaaaagtgcaaagaccgaaaaaatattacaataattctatcaacttatatactaatgtcagttgtaaacttattgcactgactatggttgtttgtctataaaggattcgttttcgtgtttatttgtcgttttcaccgccgttagatcttgattcccaaaatgcgaatttctcagcaccacttgcgtgatcatgaattcacgcttgtatcatgttctatgcagtatcttcccccaaaaaagtgaacaaggggggggaatcgtgtccgtacagagtaacacgtacgaagtattaatttttgggtcaatacccggggagctttacccccaaaaaatattgtgcggttaaattgaagtttgaggttttcgcgattattaagaaagatttcgcatgaagttttcagaaaacgcgaaactcctggcacaccagacaagcattatttttgtagcaaaaggaatcgaatagaagcggactaagaaattcgcacagatgtttgcaacatctgagaaggtaccggaacgatacataccgtaaacggtaattcatgcaagatggtttcgtgaaacttacaggatttgcattcactaagagccaggacttgacgctttaatctgaactattagctattaggactttttggaactagaaactatttaaacaagttatatttgtccatattttgcagataaagtcatacatattgtacatttggttagatttaaagtgtgttcctagatattgtacatttggttagattttattttcgcggtagcttagttaattcttttagcgtttttattattactattattattgctgttttatatattggattagtatttaacaataattccctcctgtctgctgtttcgttattaactctttcttactaaaggaaaccaactactaacaaatagtacaacacacatattaataactcaataatataaaaatgtcaggtaaaggtggtaaagctggttctgctgctaaggcttctcaatctagatctgcaaaggcaggtttgactttcccagtcggtagagttcacagattgttgagaaagggtaactacgctcaaagaatcggttctggtgctccagtctatttgactgccgttttggaatatttggctgctgaaatcttggaattggccggtaacgctgctagagacaacaagaagaccagaatcatcccaagacatttgcaattggctatcagaaacgatgacgaattgaacaaattgttgggtaacgtgaccatcgctcaaggtggtgtcttgccaaacattcaccaaaacttgttgccaaagaaatcttccaaggctaaggcttctcaagaattataagacagattacaataaattcccttcacatctgtgccccactttcaaaattataatagttacgattgatgagtacaactagctggtgctgtgtacttcggaatttgattcttcaactttataattctcttggtttgatcataagaaaaatcgattatttctaaacacttttctcactctctgattaagtctaaccaagtttgtaacatttataggtataacttatgtatattaaattaatatcaaatacgttgaaaataaaacgaagaaaaaaagactgtgtctatctcttgtctgctactatatccactataatgtttaccaccgatactaatacttctacacctactagcaaaatgacgatgaattccaagttctcttcatgcgaatgtcctaattgttcttttaacatctgcaatagatcgctgataacttcaagcctctgattcaccaatgctaccctttggttgatctcaagataacctcttgttgcctgatagatcggttctaactgtggctcagaccacatgatctctggtgaatctaatacggaaccatgcaaattgatatttatccttagaatgaataactcccctatacttttcatgatatcctctttactcatcgagactttaccactcgaagcaatttcttgcggtatgtcttgggtatcttcgatggtattatccaccaactcttcaaacaatgatatcttgacactttgcgctatggcatgagatatcgatagtttaatcatgtagttggacccatcacgtagagtgataaaatcgttgtaaattctgggttgataactctgtgtaatgtaatagttaaactgctcaacttgaacatcttcctccgctagtttctccttttcaaacctttcaaggtctcttaaaaatgccttttcttctctctcagtgaaaccccacatcactattacaccatactcgaatatgaacaaatctggttgtttatcactggtgctgatttcaccaccttcgtcatctaatcttatcacgtcctcgtgttcaaatcttttgtctcctctccaatccgtatatataaatggcgtgtataagcactcatcgaaaagcttcggatgtgtatgattgaaccttttgcagtccttgagccatcttataagttccttcattttgtacaagctcgcagtacaatacgctgtgactctgggtaaaagatgtctttgattcttgcctaatttttctgcatctcttctagcaggcttgtcagtgattctatttacctgtgaatacacgtcacgatcctgaggtgcatcgtcttcatttatcctttcgaaagcctcatctggtagtaacttaagtttctgtgcctttcttgaagttctttgaggaccaacttttgtactaacttttggaagcagcggatccaggatagtattctcttgctgttgctgtggcttccttgcaacattagcagtttctgttgcagaattcgtgtttggtatatatttcccaccactgctaccactggcagttgaatttacccccgcttcccgacggctgacattcgtgttagcggacagttgacctttcccatcttgtccatctagtaaaggctcacgttcttctgacatatttattattagacgcacctgtaaataatattctattaactttagaagcctagcatccctcagtcccagtaatcccttttggctgacagtataggtggttcaaacgcaaatacagggtattcacatctaatttacccgaattccaagtttcttctacataacgtaatttccatatcctttccaaattcctaaatgtttgaagaaaaaacgtctaaaacaactttgtcaaaatcgttcacataataaaaaggccaaaaacttcactttaaccaacatggtgatatgttaattacacgagtctattttaaggtaaatagatttaatggttcgcgagattgccaaaggaaaggttaagaatacggattggaaaagcgataccgatatttgaagctttttggagaaaactgtgcaagaattgatttcaaaaaagaaaaatcgtcaatcaatcttcaattgtttatttaaagagtaccaatattgaatcaaagagctactttaaattgcttaaaagaactaatggcagaacctcaaatgacggataatgagactacaaggccagaagagtcagaactagcaactacagtaaagaatctaacagaagaaaatgaagcactctcactagcgcttcatcgtactcgtctttctgtgaagagacttagacttgaatacggtgtccttcttgagaggttagaatccagggtgcatgcagatcagagtttgaagtatgattctccattgcctgatcttgagtcctttaggaagtcgttactggagtcaatgccagccagaacccgtaagaagaaagggaagagcaaagataagagagatcctaatctacccaaaagacctaccaacgcgtatatattattttgcgagatgaataaggacaaggtgaaggagatgaatgagaatacggatatgacgagattgatggctgagatatggaacgggttagatgaagaagcaaaaaagccctactacgatctatataacgaaggcagacaaaagtacgagcaggaaatgtcaacatattccaagaaaaaggctagccaggatacggaaaataatgaatccagtaatgcgaatgagaacgagaatgagaatgagaatgagaacgagaacgagaatgaaaatgagaacgacaatgagaacgacgctatggacttggattctgatgtcactcaaccggaaccagatttggctactgatcagccggatgaagatatggaaagcgaaccaaatagcgaactgtaatctgctatcattcactgtgtaactatcttacgagcatgctcatagaatgccctcttttgtataattaatctaacttccttcaacattaatattaacattcactgttaaataattgaaatatactactctataaagttttaattatgacgggctacttaacgattaataaatcccgaatgcaattatggaattcttcttttcttgttttttctctgatagaatccgttttcatccttttcatgctttctcttttctctagatcttgcatgcttctttagttttctattagctgctacatcaggcgctctaacagctaaaaccgctctctttgctcttctttcttctcttcttttaattacctgctgcttaacactagcatatgctgatgtgaaagctgatacagatattttggactccaagatttttatgcactcttgagccaagttatgaagctcctcttgatcttcgtctaatctgttaacattagtttcaacatacatgtataatggcataatgaatttttctgcctcttctgacaatctttcgctgctcaaaatctgcatggttaatgcagccagctgaatggcagcttttttcgaattatgagaatcgtttggattatcctcacttctgattatccaaccagttctagcaatggcaaactctatcgcgtttgaatatctggacactgaattctcttctgaattatgaatgtacggcgtattattttcattccatttcatgattataactagaagagtcttcacagcaactgacgacaagttttcaggtaattttggtgctcccaacagacggaaaattctatatgcgatcgtttgaatttgatagtcatccaatggagcctcaagcttggaaagattgttaatcaattgattgacgagacgaacagccgagagacgaacccaagaatgagggtataacagacagttggcaatttgcttccaggtctcatcaaattcgctactgaatgcttggccttcatttttagcaacataaacagtgaagacagataatgcggtataaacgaggtcccatgaagaatctgatccgacgtttgtattggaaataatagacttcacacgagttatcgctaatgtgtcaagagaagggtttactccagctccaagtttattcaggtaaatcttgtagatctttaaacccaaactcaaaaattgttcattgtcagcctgctttaaccacgcggtaatgaacttttcgatttcctttacatttgctttccccaatttttcaaagagtgaggcaagaagaacggaagccatttcacgacacttcggggcatcatcttggacgcaaacgttcgccaaggaaacaaagaaagatgatgaaattttcttcacaagttctgcaccagatttgttaatgactaagttgacgagttctaagactgattgacgaccttcctgagatggatactgcaagttgttcaacataaaacggaactgtttttctaatcttcctttactctgatcatattccataaggaaatgatagtacacacctctggcaacatctctgatctccttagaatgatttgtaaccatgatttccgcaatattgtctacaacatcataaagttctggaagtactatgtgctttgatagcaaggctttgacgaagttgaacgccaacccctgtttgctaggttccatcaagtcaggttggagacgtcctaacaagtaacccagggcagtatctttcaattgaatatctttatggcggagcatgactgataaaaatttgaggcccatctgacacaagtctgatgatgttgatggtgaattcttgacaatttctaagacctttctggcacaatttttgaatatagcctcagcttcttcttcgaaatccaacttaattattatagtcaaaaggcgtaaagtagccatgacaacaccctcgttatcagatacaagagtttctttcattaatgggatgaaaggctgtagatatttaacttccattaggttggcatttttggtaacagccgttctcaatagatctaaggagaatttttgcaaagtatgagcgtaaatagttgtatcgttctggacagtgcctgatttaaagttaagatcaactaaaaagaaatctgcacgctcatctttagtggttctgactttattgggtctattactcttgtctgagtgagattgattaaatatctcatagcacaatttgagaacgtctggagatgacgcttcttgattatgattcaaacccaaggcataccttcttaataattcattgagtttgttttgcgattttagagcaagcctttcatgcaacaatacattgacagggcgcaataacgacccaaacattgggagggtgatgttggatgttaccaattcaccggtatcataacttttattaaatttgacttctttcattttggatgtgtatccttctgcatccttttcttgaccagcagcaccaaaaatatcctccatgataacatcgactatcataccaacagattcatcaagatcaccatgaacaagggtttcagagattgacatcaatacgaaatgcaaagaataactcaaaacatggatttgggagcccctggtaagagctgactttaactccttgatgacgaaagataagtattgtgggcctagtataacagtaagatttgctaagttctttctcactgcctcacgcaattcttccgatctactacgtaaaacctgacatacactggttaaaataccaggcaaaagtgccgcagtgtcatccttttccaagcccaatgcgaggttcactaatgcttctgataagtgaactctagacacaattgtttcgtcatctctagtcgataagatcttactcaagctagggaagatatcttttgttatgaaagcttccggttcttgatagctttttgggaactttctgagtgttggtagggattcatctccagttctcattgcttgtaaagagttctttaaggaaacagaaatattgacaagaagggaaaccacttccttttgtttttcagtattcttcttcaacatagagctgtaccttctgaataaggctttgtattggttccatgacatatagttcgatagagtaccgatagtgataagggtttcgttaccaatgtttctgtacttctcttcggtagagaaaacatagcgctcgaccataggaattaagtagtgcgaaatactgttgtcagaaagctttggagcatagtcttttagacgtctgacagctctttgacgacgatgcaactgaatatggtttatattaacgaagaaatcagcttcttcatcaccattgtgtaatagaactttcatatcttcaatttcaaacagatattgagagtttgtgacaatataagcaatgagagagatatattcattttgaatctcttcaatgttctttcttaaacctgacctgatatttggtaaaatgatggttttcattatgtctatgtatgcacttgcatcttcaactgagagctttgagttcatacaatcaacaaatcgatttaatgtgtgagaagcattagttctaatagctaattcttgagtgtcattgatgaaaaacaagcatgagtagattacaggcaaccattgcatttctgtgtaagagtcacattctttctctgtgaagcgcttgaatgccggtaatcttctttcaaagtcatattctctcattctgctggtcgaatacgaatttaaatcagccaacagcgccccaacagcctcatattcgttgaacctcgcaccaatgctcacaaaaatattgttcaatgcctgtctgagatccttatcagaataagatctgtataatttagatgcggcaatgtacaatggttcaacttgtgaaaacgaacagtcgaaattatccatcaaagttgataatgtcttcaaaagtttcactttatctttcacagtgaattgcgagagatctttttgcaatgcttgagtcaatgaacccaccaacaattctcttgtttcgttatcttcaacataaccaagttcggtgatatttagcaacaagtctactgcagcagaaataacagtactttccgtgcacctttgtagtagcacaggcaactgctgcaagcaaatcgtaactatcataatgattagctcaacatactttgggtcctggtcagggttattgattatcttattacagaaattcaatatcacacccactacagactcctttgcatttgaattttgtaatgttttcatcaaggcagctacagcagacaaatcatcaaagtataggaaactgtagagtgatttttgttcagcccagtatgtaataattttcatgacagatgatacctgttgcaagttctcatcttcaaatttctctagacggggtgtaatcacattattgaatatgtcagcagtaaaaggcctccaatccaaaacgtctcctagttgactaaagagattatgcaaacacttatgtcctatttgcctcaagttagatgctaccttttcgacaaattgctcatcggacttttcagaaacaataaagtttgacatgttgatagcatatattagaggccttataacagttttcatcacgtcgggatattgggaacccaacactgccaatgacgaattaacgacattgatgaaaccaagcatctttcttaaggtcagagaagtcgcataagtaaggtcaattttattcccattctcaaagaagtattcatatttgaactttcccgtggcgagctgcaaaaactgtataatgtagcggttttccaaactaggcaaaatagtgattactgcagttttcctgctcttcttgagaccacttgtatttggggtttgaacacggccgaagagaattctcacaatataacccataacagcttcttcatcttgcttttggatagttttggtgtcatcggttgctaaaaacttggtaatttcatctttaaataaagtgtcatccaataagttcttcaagttttctctgtacttggttatatgagattccttgtaacaaaacaacgcatctaaagctaatttttgaacttctgtagttctgctgctcaaaagtgccattaacctatcgtgcacttcctctgatttgtaaatggatttgatatttttgaatttgccaacgagctttaataaaaggtttctatcactttcagtccattgtgatgctgttggaattagtacatccatacttggttgatcttctgtgataaaaatttcttcagattcttcttcattaaataaaaaaggaactatgtcccttgaatgacgctctgccaaactaggaatcgacaataaaactttgaatatctgacttctaatcaatgatggatataccatagaattccttctttcctccaaaacatccaatatagttgaatcgctagcagagtattttttaaatactttgtcagaagcaaggatggagtcattcattctattgatactaacggtccagaatggttcttgaaggtcaatgttattggaaatgctataatatttgacgtcctttgtttcatcaagaacagtgaggaaacgcatagccaaactccacacaagggattggtttttggtgtaaacttctggaattatttcatagatagcttcccaaattggagagaatctgacagttagaagcccaaacatatgtttgaaaaagacattagtcaataaatcctcagcttccatcttggcaaagtctgcacctagtttccttactctgagagtaatgtcacggcttgtatgaagatccagagggatttcttccaaaatccttagatcataaaataattggggaactgagttgccttgcttttctagaacagatattataaacttaagggtttcgtaacggatggttttgtccggaagtaatagattatctgttaatatgggtaaaatctttgataaagatttcaaaatatcagtgtcgtcctccaaatatgataaaacatgtgaaataccttcaataaaatatctactgttctgtagctctataattctcggaactagaatattcaataattttgcagccatgaccgactcagatgaagtgattttaaatgttaatgcttgaagtaggaaaccaacaaaatccttttcaaaatccgataacacatccttttggaaaaccctctctagcaaatgcataatgatttcctcatcctcttgtttcaatgtctttaatattataagtttccaatacacagaaaaaatttcctgttcatcgtttacattagcatcgctgatatccttcaacaactgggttgcgaattccggtgcagagagatgatttaccaagtccaaatcttgtgaagattccgattctaaaaggaacaatgcaatcttctgagcaccatctgcccagcagttattaacgtatttctgcaagtatttcaacccgttgaaagaaagcactttacccttatcgatatccatagaaatcttgaagaattcaatgaaatgagctgagaatttcgtcaagtagagttcgaacatgtatttatgcagagaagttagcgttttaacgtcagcattacgtaagacgatggcaaatgtaaacgacactagatctgcatgtgattcatttagactatcatgttgagtggctttacgtagaacaccagataacttttcccaacttggtacttttctaccactctcggcaaacgatagcgtagataacattctcaacgttttaccaacagcagcactagatccgttcaaattctcgtccaagaattcaaggatcaaatcgtataaactctgaatattctccgcagaagtgtgtctagtgatatctagaatgatgtcacaaagtaaagagacacatactatgtctgaatttttctcgaatgcgatttgcagaagagtttggaatattatatttgatcttgaatgcaatgcctcggaagtactcttcaatgattcaccaaataaagtttgcaaaccgtcataaaaattatcattctttaacaagcacaatttttggaacgaaaatgtgacaaaagtggccaaatgtttctgtggagatttccttattagaaacgatagagcctcagcggagaatctggagaggtattctttcttatgtgacaataacggaaataagaggtcgaaagtgggcgtcaaattctgagtcaaactacgtgacaaatacttgaaaatgtatgccaaacaattgaacccccattcgaacacgtttgagttttcaaattcagtggcagcttccaataagttaatcaaacatgtaaccgccctttcataaaatttcatgaaatcaggtcccaaatcatgacagaactgagccaagagatcacacaacggctgtaaagatctctcatcgtgtttatctatatattgctccaaattcgcaaagatttcatcctcatggtacaaaagttgaggcaaagtttgaaccaatttctctaccgaatccataaaggatccgaaattcccactcaaattgatatccttccagtgttcaaaagaggatagaaaatgggaggtctctacatcatcatgaacccttctatccaaatttctagcaggttcaatcttcaaatcatcaatcttatccttgaaagatgagtatctatacctcttggtagatttcgttgtagtcttttgcttacccatggttgattattttaaaatgggaaacagaacaagactagtcctcaatgttatatcaatgtactgaagcaggtcttgtatgactggtgattgacagttactgtgtgtagaccctcttgtgtttgttgtttatgcgatgagatgagatgagatgagttttcatgcttttccaaattctgaaaattttccctttacctagaatggaacgtgaagaaatccagtttctttttacgcagggccgatctggaggacgactacggccacaggactgaccgccagcactgatcatttatgaggtgtttttaacgggccaggaaggtacgatagttgtgggagtactaatagtagaaccgctacaatatataagttgagagtatccaacctagaatcgcgaggtaatgatagaacttcaactaataagaaactccatcgtctcattatacaaaaattggtaaacattatgtagcgcagaagtagtgctgattttggaactcaacttggttatatttgaggctctgcaacattttctggacattcgtggtaaaataggtatatcctttctcttaaatttccagtatttctctccatcggtctcttgatatattatatatactgatatatatttgcatatggggaatagtcgtttttaaatgaaatttgtcatgattcgcgatcagatttcctcgctactcttgctgcaacaaggatatgccagcaggactccagagggcagtcgataggagtttgaaatccaacctgcacacgaagctatcgctgaaaggaggatttcccactggattttttgttacaagtcgcttctcgtccccttttttgtctgttgatatacaagaccttcgatcaaaaggatcggaaaacaaagagggctaacccaacaccaagagcaggactcctgaacttactaattgaataaacaagggaagtatatcttttccgggttctaatattgctcttacttcgcctgctatgtcaaccacaactacatctacgccatccagtgttgtcagcgctgttcaaagtgctaccactacatctgctgatattgataacaactgctggggtctctcgtgttcctcccactgggaatgggcacggtgggtaatattcgttatattcatgttcatcttactggcatttgtcatcactacgataagaataaactatataagaaggcgtaacggacaacaaccacttcgatacgtgtcatggctcactccgcccacataccgacaatcagaagctgtaagaaatagatcagatgtcccattggcagattacgtgcctccgtacacagaagaagcaaatgaaaacgatttgggttactacgatcgtgatgggatattccacgtgaacagtaaagccgaccctccaccaccgatagatgcgtatgtgctagagcatcgaaacgatagggatacggatatgatagatttggaaatgcaacggaccacggctacggcccagcaattgccggcatataatgatgtacctgaatcggagactgtagaagcctctcgacaaaaccctgaatcagcccaacaacgacggtcatcatctgtgtcaacactaatccctgaagcaccggctgctacaaatctccggtgaaaacgtaatacaagccattaaatgatcttcaacaaactttctacacatcatcgactctctctctctctctctctctctctctctccatcttcacctacctatttacagaaaacgtgtataaaatgtcactcttcttccatacgtatttaatatcaaactaactatgtaacaatgtattataaggaaatccagggcattcgtattcggctaatatcctgtgcaatgagtcacactacaacatcttctttgcatcggctactattgtactatgtctggtcataacaaggcttttctgttaccagcgatggccgtttcattcagaatgaccttgccaagccctgaaaagacgagaccctataaacaccctacaaaagactatatccacgattaccgcgctgataaaacccttggtatggaatccagttccatttactaaccgacgctgtggctctcgatcgacgttggggatttcgagtattaaaagagccagctgccgtttcaacacatcccacctctctttctctttctcaccctctctcttttccacatttcagccattccttttcatacaatttcaagaacaaaataaacgaatcatcgagactaacaaccaccattgctgcgatttgataagttaaagttatcgtacgaagccattcactcgagaaacgaaacccagaagacgatattatgcccgtgcttgataaacgtatatattactattctagcggaagttcctggacatgggatagatggattctatttgcgttgctaatcgttgggcttgctgctctcatctttggaaccaacgtgagacgtagaagaagaggtgcccagccaattgttggtacttcttggctagcgccgccaccttcttacggacaggccgctgctcagaacaataactacaatccaaataaccctcagatgagccaacaacctcttccgttatacacagaaaacgttaaccagaatgatatggggtactacgatagcgagggtaagtttataccgacatcaccgcaaaatgcatactacgaagggttcccattgagtgagcaacagcagcagcaacaacaacaacatgctgcttctaccactggtgttgctccgggcaatccaggatccagcacatctactacacctgtagtccatgacgatcgtactggagagagtcaagatatttacgtggaaagacctgaacctgccatcacctcacaaccgaaagtgtagacagcagaccgactagattgccaaactccaacaaataaaaaatggaccctttcatcagaagtaccaattcgaactattcttaatgcaaaaactaactctatctaatatatcattaattattgtataatactcgcctctaactcacaattgtatattatctttttcagcttggactccagttctttcacgcttcatccttcctacttttcactcagtttccctttgcattcagtttccatctcgagagtcgagataatccgaattatcttaatgcgcgcgcaaaaaaaggttaagcagctgctgaacggaaagatcaaaagaagaacatataaatatagctctactctctgtagttgatgagtgtttggaatgttaagtaactaaacaatcattcttctggttgttgagtttttgatatctctcaatataactcacagagtgtaagtctttaaaccctataaaagtcgaacatttaattgattacagataatggctggtatcactggtattactccggagttcaagaactcagatttgatccgtaaaggtgcatttgttgatggccaatggcttgagactgcttcagaaacgtttaatgtgactgatccagctactttggaagttatcgctactttgccagatcaatccattgaagttatccatgaagccatcgatagtgctgcagaagcgttccgtttgtttaagaaaactacaccaaagaccagatctacatggttgcgtaacttgtacaatttgatgatggaaaacgtcgacgatttggcaaagattattacttgggaaaatggtaaggctctatccgaagctcaaggtgaagttaagtatgcagcatcttatttcgaatggtatgctgaagaagcagttagaatgtatggtactactattcaaccgaataatggatccaatagagctttcaccgttagacaaccagttggtgtctgtggtatcatttgtccatggaatttcccaagcgctatgattaccagaaaggccggtgctgcattggcagctggttgtaccgtggtcgtgaaaccagattctcaaactccattgtccgctttggctttggctcatttggctgaaaaagctggtttccctaaaggtgttttcaacgtcgtattgactgctaccagaactccagaattcggtttggctctatgtgaatctccaaaagttaagaagatttcgttcactgggtcgaccaacgtcggtaagatcttgatgaaacaaagtgcatctactatgaagaaattgtcctttgaattaggtggtaatgctccggtcattgtcttcgacgatgctgatttggagcaagccgttactcaaactattttgtccaaatttagaggcctaggtcaaacttgtgtgtgcgctaacagaatctatgttcaacgtaccatcattgattcatttgctgaaaaattggctaaacaagtgaacgagttcgtcattggccatggtttggactctaagactactcacggatgtctaattaatgaaaatgctataaagaaagttgaagctcatgtaaaggacgccttggaaaagggtgcaaagaccgtcgttgctggtggtcgtttgccagaattaggtccaaacttctacgctccaaccgtactatctcatgttccatccacggctgtggttaataaagatgagactttcggtcctctctgtgccttgattccattcgataccatggaagaagtcgtaggatatgctaacgatactgaattgggtctagcatcatacgtgttctctaagaacattgataccgtatacaccgttgctgaagctttggaaaccggtatggtctcatgcaacactggtttgttcagtgagtgtaccattccattcggcggtgttaaggaatccggattcggtagagagggatctttgcacggtattgaagactatactgtcatcaagactatcaccatcggaaacttgcctgctccactataaattgatgggcgtaactgattataatagtagacgatatgtaccatatgtatatagaaacgtatttccagtagtgtagcaatttatatttatcctcggattaagagcggattaacatagcatgatataagttgagttgattattcaacctgagttaaccagttattggaacgagaatccaattgttttctatttgatagcctcgtattgactgtttcgttacgcgtagtgattgtgattacatttaacaattgatttgaaaaaacgttattatggcgtaagtgaaagcttagtaacgatctgcaaagataaagccacaacagtaattagctgccactttccagtactcagtgccatccttcacttgagcttagtgggggttcagctgctgttgttttcccaccatggatttatatgaacaacttccgtccagtggtatgattcatcaaccggaatacaagttcttactggatgccgctacctttcatgggatcacctgcttagatttcctatcccagtcaccatctaacttgatgaagaccattaatagatctatcaatgagattataaagtttcaagccgctctacgaaatgaattcgaattggcattggccgatattaagatacaagacatcacaacactgaaggaggatgacaaaccacgatgtttcaccaccgggaaccttggattagacaaacttttaggcggaggcatatattcaaaaggtatcactgaaatattcggagaaagtagcactgggaagtcacaattacttctgcagttggcactctctgttcagttgccagaagacatgaatggccttaacgggcagagcgtatatatcactacggagggtgacttaccaaccagaaggctgaaaagcatcatagaacaatcatctttgtttaaagatgaaggtggcgattgcttggtgtctcaaaagaaaatattcactgtcacctgtaatgactgggctaatcaagaacatgttacaacagtccagcttccagtcctactggaaagacacccatctattaaattagtaataatagattcgatttcgcaccatctcagggttgagttgcaatcgaaaacatttcaagaatcgagatcaaacaggtatattatagattccatggcagagaacttactttctttagctcaaaaacataatttggccatcgtcgtcgccaatcaagtaagtgacaaacttttaccagagaagccaatacgacaggacttcaaggattatgattatcagctgggctggaacatcggatggaagaattcgactattttttatagacacaaattcaatgaaatagagaaatatgatgagaccatattgagtgacgatgaggactatacgttaattgtagaccaggttgcaaggaaattacaacagaatgttccggctagtgttccagatacaaataataaagaccctgcgcagtctgtcgcagcattgaggactgaagcgctgcggaataatgttatctctcaacaaaactcacctcagcctactcaaagtaaaacccctgtggtaccgtcacagccccaaccatccgcacctttcctgttatcaagaaggaaacgagaagttgacacgaaggtaccaaatctcggtttaacttgggctaaccatttaatgacaagaataaaactggagaaacgatataaagcatcacctatggtacgcacgggggaattcaattacaacaatacaacagatacctctcaattttggcaagtgcagagaaatctgaagctagtgttttcgacttatgcggtgaaaggtgaaatgaattttgcgattagtggagaaggtgttatttcggtacagtgatatatcaattgcgctttaactcctgtcaagaaaactcaaagatatggagaaatataattaagcaactttgaatcatataaagtgttacgtgttgcgtatttattttgtatggaaaggttcagtttacgtcatagaaggactgtcatgattttatatttatatttgaaataagaacaatagtgttaataataaaacataggtagaaagacagagagagttagaaaaaaatgatacagcaagaagaaatactataggttacaacatccaaataatgcactgctttagctatcgtgaacttggggaaggtaattcaataaaaatacaggaaagcgataagttggttcgaaaatgtaatgataatcagttaagatcatccatggcttcatccttgaaatcttcgttgatgccctcatcatcatcaattatagcattctcctcataagttaaatcatattcgccttcaaaatcgttgtcgttatctaacgtcaatttccttctctgtttacgttctgattctagtttacttgaattttcatcttcgtcatccgccaatatgacactatttccaacagagggagttcctttcaaacggcatgctgttagataaacatatgcgactcttttcctttttttattgaacaaaaaccacatcaatgaccaaagatggccaggctcatcttcaagaaacgatttttgagggacatattgatagaaagcgcaatcgttgatatccatatgtccgttgatcgtttcccagatccattcctgaggtggttttcctaaagatatcaaggtattttcgaacttcgagatgaaacttttcttggtgcatttcacgaaatcggtgggctctaatgacgaaaaatcgtgatccggataggacgcattcaaaatggctattagatacgcgaaagctctcctgctagcagtttcgttgataggtccaaacggtccaatatttacgttgtctcttccttgtaccgatgacctcctcctctgttggtatgaagtattttgtatttcattcgctgaaccacttgtgctaggtcttcttttcgaagtatcggtatggttgcttgcaatgcttccagcactgctagtcctccttaggaaactgggacgttgtgaagcgatccctaaaggccccgattccattgatgatgaactcaaatatccgttattggagttagcattggtggtactactattactattgttgtgtccattcgtgacaaaatttgtactgtcagttgacagcacgaattccttcaaattttggtcgttcaacttattagattttattataggtgacgaactatttgtcccactcgaattctcgctaacagacatccttctcttttgttcccagaatgaattagggtttgggctctgttgctcttgcacattttcatcgatagttctgttcttttcgtcaaaagattgcctcctgtgagctgcagcagtaagcgactcactttcttgaagtaaggactccaaatgacgatctatggtcttataaagcttcttatctgaagctacgggctttgtcgtgaaaatgtcgcaaccacctgtgatactgcagtccgaggtctcgaaattaagagcctggttaacaacctctaaatcaaattcatcgataaactttaaaagatgttaagtaacacatgatgcaaaaaatatacatacatgccgttaatataaggttagtattccgtttgttcattatgaatatgtcagaactatattaaaacacgattattcgcataccttcattattgcaggttaattggaagcggtgaaacgtttgaaaataaaacagtattcttgagagctcaaagacacactgtgctagattcaactaaattgacggcctcctatcaagcttgttatggttggctgttcgaaaactcattgtaagggcagcgttatcggtctttgtgataatttcaactcagcacatgttacttcgagaaacgggaacgcgcattaaaaggtcgggtaaccctcagttatgaggccacagctaggtgagttgaaagcagacagcaccattgaacagaagctaccatctccaagctaacattgacattctatagtcaaaaagaagttgctttatgtatgttcctgtatgtacaaatccgtggcaaccacaactttttatgcggtaaagaattaaagtattatgatattagaaattaatgttactatgtgaaataaatgttgttagagaggagcttgctctgtgagtgaacgataactatagatagtccgttttatagatccagtctgctccaattagatctgctccttgatcctttgcgagtctgaaccatttagctgctcgtcttaaatcttttttcctatttggagtcgtctttgaccaaatggtaccgcataaacacatagaatcaacgtgtcccaacgatgctgcatattccaaacatttcagacccttccattcatgagcagtgacaccgtatcccttcatataagctataccacattcgtacagagcgggggcagctgcgtcattctgtagagatggaagcggttcacgtatctcaaatggatctatatttgcatgtaatacgctggttttgaaatccttgatacccgttgcacctctaatccagttaaatgattcgtgtaaatcgatttcggtaccagacccgtatcttaaggcaagaccatacagcaaaaaagctgttctgtcctccaatttacacgcttctttgagatgtgcagttgaccctttcaggtcacctttgtttcttaattcaatggcaatattgattcgttgttttgcaatgagacgtttgttagagttatttctctgcactagttcaccttgtgatgtagatgatggttggacgacaggttcacggtcgttcctagatgcagtagatgaattggacgaggaagaggttgtagaaggttttctaccacctaaagtggttactggtaaaatcgttggccttggatccaataacattttataactatgttgtgatctcgaagcagaccctgagctctgtttggagctcgaagaggatgatgtttgtggttcagatctttgattatttgcatgagtgatatgcgaaaagattcctcttcctttggagagactacgtttatgattggtgctttgatttacattcgtagtttgtgattcattcttgtccttataaagtgagacagtgttctcttccttgtcatagcgttcattttcttcaccaagattgagctgatgtgggaacttgaacttagatgtcggtgtatttggtacggaagtagattttccaggagtatccacaatcgtcttgttgctcattggcgatgaataatcatttattggagtttcaggttggtgatgacttacctttggtgatttgaacaaattcttaaatgaaaatgatgatgatttcttcgattggtgccctttcttaaagtccttgctaggtggtgttgaaacctcgaacgggaacgaaaggaatgagttggacgcggtactcttctttggtgtttgaaacccgttgactagaccattagattgctcactctcggatgatgattgtgttgagggatggtttaatacaatggaagacaggctcgtcttgggggtgtgtgatggggtgtttacaggtgttccaaattcgtatttattataaggagaaaacatcatatcagtaatcgctggggtaacgttatatcgaactggttcatgtttcttgaagcgaaacttctctatgtttattggctgatcagatgacgtgttcggcttcacaccattcgatgcagatgtaacagtccccttttccacaccattactggctcccgataactcagtcacttgtgattgtacctcgtcgtcatcatgttcctccactgttatataagaatatctcagatctgccacgttgttctctacagctattgcctttgaagtttctctcttggtatcttcagaaatcattggtgtcgagccggtactagagatgcgtcggtgactgaaaccggagtgtcctgaagaatgcctcaacgaaaggaaacctgatgctggaagacatacggatggtttctgtctattcacttttgatgtctcttcgcgttgcttctcttgatcactttcctccaaagctttctgcaacaacagttcttcctcagcacttaagtccaacttatctaataatctccctgtcgtctgaattgaatcaaaacttatcacagatacgttctcatgctgcagccccattaggtcagatcgggtgcctgtccgcttctgaagaccatccaacggggaaaaatgttcaatgctcatcgtcttttcttggtctaacttccgctaaatcaccgactctaatgtttatccatcaattgacacgttatgggacactaaaggaagaactttcctagttagttagagctaaaacctagatttattcctttcttgatgcctctctatgattatttgtttgtttctgttttgttttttttttcaacgttttcatgacagccgtttgtaaatgtggaatgcacaagataactgaaacaaatgatgtcatttgagtaaagatttgaaagacgcgtgtttatccgggagatactactacttgttcgtggatgaatgtatttgatagaacatggtatcaatgttaatcattatgaatgctaaatgctaaagaacgtttatattgtttgtagaaaaaaaaattggataaacacaacggttgtgagtggagtctgaaaaccaatagcttcaataaaggcttataagtgagtatgcctcttatgttacaaagaaagaaatgaaccgaatttgaaagttagaaagggaagaattgaagtttgactttttttgccgatttgattgagaactcatactttctcaactttatcgcccatatattccaagtagtggcacccaaagacagaccagtgaaagttgacaaccgtgtataaatgacgataggagttttcgaattcttccatatcaatcgcagcgaggctctccttaatttccatctctttcttgcttgtagatgtcctgtttgcctctgaaggtgactggaaaatagaagaaacacccgttgaatcatcatttgagattggtagggttgatgtcgcggtaccagtagcattggtagcagtattggtgtttccgcacatgttgataaagtcttgttttaccgtgccatcctttgagcactctccgaatttgaacacgatttcttcaagagacttgaatacccttgcttcaagaacaccatagacatcgctcagtggttgagtttgtttggataaccacgaggtagcgaagtcgatcttcttatgatctagagataggttagcacttgatgaagatgacacctgaggagcgccagcaccggatgattgtgtgccatcagaatattgtcttaagtactcctctttcaattgatcgataactttgttcaattgcactgcaatactcagagtgttctttgtccacctgcaatttccatgttcatcggtgataatactaacgatttcttcctttaacctctttgttgtataattcttgatgataaattctttcattggtcttgtcaaatccgcgttgttagccacaagttgtttgaataatagtttgcaaaccattaaacagacaatttgacgaatatctgcccgcaataaaatcaatctagcatggtcgaatgataatgctgtagggtattctttgaccatctttctgcaagataataagcttattacgcttctgatacaaacttggtaaagttttggaattggggttggtttggaaggatcgattaagttatcagcacaagcatcattgtatttctcggcgaaccatttcaaagatgattttaagtcaactctgttactattcaatagagattggaaatattgcttttcgaaatctacagtattgctcaaaagcgctggtcttaagattctaatttggtgatttgcaatgtctaacttcattgcttccagaatttgaaacaccaatctgagagcttccaccaaagtcgatattgagttattttcctctgcttttttgaactttgaggacattttgtctacccatggatctctcattggtgcgcaatggtgtttgaataattgtgataaccagtcactgaaatttgacattacaagtgatccctttaagagctcttgaatcaacaattcagtatccaaaacgtttgccacagtagatacttctttttgaggaactattgttacaagaacatctttcaaagtattgaatagaggtactagtctagatctgttttcgtcgaaaacatcaggcctttggttgtaaacataaatttcattctcaacatcactccagtacttatcggcaatttgtctcttcttgatccctctttcaccatccaaatttggcctaaattgtaacataggatcgaacactatgtcgtgtctgagttgaggattcttcacaatctcagacaaatcgatctctttcaagcattgcaaattaattgggggtaaaggaattggagttgggtatgttttgatgtatttgattctttcttcaagagggatatccttactgtccattgtttgtagacgatgtgtcattaatatggcgtttcttaaggagaattgatctttctttagcgatctcttcttccttacaagacctcctggctgactacaatttgggtttaggttggagtttgagtttgtcaatgaagcggaggaagtgttcggatgttttaaagttaagtgtgcaggtggtaagttatgtttgcaaggaatcatcatctcatgctgagcaacactactcattttccttagtgacgaatgcaatatggtaggtaccgaaaatgatctcatctttgatctatgaatacggttaagtgaaggttgtgcagtaagagtatgattatgatgttttttctgttgctgctgttgctgctgtttgtcctgtatttgttcctcacgagattgttgtaactgcgatccttgctcattctgattttgatgcgcgatatttgtaactgaattctcatttttttcgtagttagccttcgcaagtgatcccataagcgatggggtattatttgggaccatatttgaagttgaaggagacgtagatggtggtgatgaagcggtagtagtatcgtctggtctcaagttacggtggtgatgagcatccataagatcctgactatcattggttttcgtagatccagaggaggggggtaaaaattgtccggtttgagaatcgaacggtttgaaaatggttgtattgttatgtgcaatggcagtattgaacgacgaaggtcgtctttcagaattgaaatttagggttttggaagatgcagcttgtttttgtctgttggtagatgacgatgatgaagcagtcgatgatgaagaggaggaagatgaagaagaagaagaattatctgaatcgtgggcatcatcatcatctcgactagcatcctgtatatccatatccatatccatatccatatccatatccacatccacatccatgtcctggttttcaacctgaatactatcttgtgaaccgacgttgccagcagccactgagttattgatgttattcttactgctgctgttactattcctttcatcatcatcagcagacactgtggcgttatcgttattattcgaattgttatgagactgtgatggagtaacgaatccatggttccccatctgtctagcatcctgtacgtaatcgtcaagatgtgagtggtgtccaacaatacggtgggaacaatctgaatttgtattcaaccccatcgcaactatcccactatcgttactgtgatctctgggcctactactctgcgaggacgatagtttcgatccagattttctcttagaaaaccctgatttccccactgttgaactactgatggaccctgaagctaggcctgaaccgttcgaatcaccagaagatgattgcgacggtgatggtgacgaaactactgccgaagctgctgctgccgctgctgctgcagaggcagcagctacagcggccgcctgagcctcgctggcagttcctgtgttattctgcgaggctttatcttgcattggtaatggttcctgaggaggtgtgttggcttgagttctcgtttgctccatcatatgagactcctttttttttatatttattattagcgatttttttattggttcctttgaatagagtcctctttataagtaagtttcaccaaatcacactgtcctatagtgtacctgaattacaacagcagatactaagctattacaacttatactgtttcctcccttccctgttacttttagaaacgagcaaaccaaaagaaagaaaaaagaaaaagaaaatccacacagacccttgactgactcttcgaggattctagtttcttattctgcaataaattgccttgtgcttttgtcccgtttgatgttcgtgctagtactgattgctggctacttacaactgagggttcttgagacaccggggggtaaaaaattatgttgagtttaccaagttatgtttagttttcaaatgatttagttttatttgtttttcaacttttttttttttttttttgcctctttccctgttccgttgatagttaatatacgggtactagatatagacatagacaggtaaaaggtactcgatatatagtggtgactcggctcctgtgacattcaatcaacggttgtagaattctgttccaattatttaaagaagggggagctttgaggggcgactctttcgtacagagtatacgagaagctttcctgaattatatgtcacgtgaacaaattcgcaccatcatcaattacattatcatatgcatgaggtaacaagtaggaaaagcaactggttgtagccagttactatgtattatcatcggtagtagcaaattctacatattcttcggaaatcgcaatttcatcatctaaagtcaactatcctatctcaatgacttattccatttctaatcatatctgtccagagaaagttcgattaccatagatactaaataaaaccaaatgggagtactgtccgggtaagaaaataaaacagtcccgtgatataaaaaacaatagagaattagaactgtcaatgttagagccaaggaaaagggggaaggataaatgggggatccacttgcaccagaagaacctgatacaagcactatactgattatcaccgggaaaaaaagttatattgtattaatcgttaaaacctatgaaaatataaaatacaaactgatgggtatgttgtaaaataatgtacagaaagaagatatatgtgtgcgtgtgagaatatcgagacaaatccagtctcttgtttatccaccgaaaccatacaaggttctaccttgtctcttcaatgcatagacgacatccaaagaagtaactgtctttctcttggcgtgttcagtgtaagtgacagcgtctctgatgacagattctaggaaagtcttcaaaacgttacggacttcttcgtaaatcaaaccggagatacgcttaacaccacctcttcttgctaatcttctgatagctggctttgtaataccttggatgttatctctaagaatctttctgtgacgcttagcaccacctttacctagacctttaccacctttacctctaccggacattgtatatattgatttgaactttgtttgtttgtgctgtttaggattctattgttgaatgaacaactttacagacataccaggaaaatatccaatccaaatgattgagcccttttatatactttagatcaggttacgttctgtttttgcccctttcttttcaaaatccaggaatagacaagatcccatagtaattgagtggtgttgcaatgtatctgaatgggtctcaaataacatgctgtaccataccggtaccgtaacttcacatctggctggtggtatatgtgaaattacaatcacggaccatctctttgtgggatttacaggttacccggagggtaacacccactcaccacataatttaacactcagttttcaattttcttggtatactttatattagacaaaccaaaacaaactgccttgtaccacaggtttcgcgtctgagatgcgaagtgcagagcacgccactcgtggctagaaacccaggtcgatttcttacggaaacggggccgtcgcatttactatggacttttgcgatggcaggaggagagaaatgaatagacacatcccagaaggggaagtaggatgagaccaattttttcttttgcggaaattgtgtgaaactctgggaatgagaacaggacatgaaccagaagtgacaggagactagtgcaccagtgcctcaagttttttaagccccttgttttcaactatataaaaggcttgatcttgagaattatctttttcacctattacagtttgaattatattaattctgatttactgttaatattggcataaaacatccaagacagtataatcacacacaatggctagaaccaagcaaacagcaagaaagtctactggtggtaaagccccaagaaaacaactagcctccaaggctgctagaaaatccgctccatctactggtggtgttaagaagcctcacagatataagccaggtaccgttgccttgagagaaatcagaagattccaaaaatctactgaacttttgatcagaaagttgccattccaaagattggtcagagaaattgctcaagatttcaagactgacttgagattccaatcttctgcgatcggtgctttgcaagaatccgtcgaagcctacttggtctctttgttcgaagacactaacttggctgctatccacgctaagagagtcactatccaaaagaaggacatcaagttggccagaagactaagaggtgaaagatcttaattagatacttttcctcttttcaaatggttttctttttttcaagtttctttctcccccttcacttcttccatgtttgatacatgattgcatggtatcactacacacatcccatataccccggtatctctcactgaacaaataataatggtattttatgtataaactcaaatcctttattctttatttttgtataatagtaatatcaattttaatataaggttatttcattgaaaaattgaactatcaaacatcagtttactaatcatttacttgggtactctgagcgagctaccctcttgcgaaatctactgtgatgctcgttaaagtgtgtggtttgcaaaccgttgaagctgcaaagactgctgtggatgatggtgctgattacttaggtatcatttgtgttcccggtaggaaaagaaccattgactcatctgttgcgaaaggtatttcaactgcagttcaccaacaagagaacgtgaaaggtactaaactagtcggggtgtttagaaatcagtccgttgatgatgtccttcaactgtaccacgaatataatctagatgtgatacaattacatggagatgaagatattaaagaatacagatctttgatcccatcttcaattccaatcattaagaggttccagttcccacaggattgtgaattactactggacctgtatgaacacgtagacaatgtgctgacgttgttcgattctggtgaaggtggcactggtgagaaattgaattggagtgcaatttccagttggtctgcaagtcatcccgagataaaattcattatcgctggtggattgaatcctgataacgtttctgttgccattaatatgttaccaaatgcgatcggtgtcgatgtaagtggaggagtagagactgatggtatcaaggatttagaaaaggtaaagctattcatccagcaggcctctcaatagaggaaaaaacgtatctttcttcaattacacatacgtatatataaattgatatatatatagtgaatgatcgttccactttttaagcagaaccggagatgaagaaccatttgtcaatggacttgtcgattggttcatctggcaagacgttagcagctggaacagcagaggcagcttcggctgagtaagtagcagtgtcagacaaagtggtgttagtcaagtcgatcttcttggcatcagcagacttaccagaaatcaacttcttccaggcttcgttacattctctgatgacgtccaaggtgtacttcttgttcttggcttcaccggagaaggcaaattggttttctggcttaccatctgggatcttgtagattctgaaccattcattggtggctctcaacaaacctggtaaatgcttttcaacatcttcgatgtcgttcaacttaggagccaatggatcgttaatatcgatggcaatgaccttccagtcagtttcaccttcgtccaacaatgccataacaccaagaaccttgacttgtttcacttgaccagtgtaagcaacttgctcaccgatttccaagacatccaatggatcgttgtcaccaacagccttagtctctgggtgagattcgtttggatcttcccatgtttgtgggaaggcaccgtagttgtgaatgtaaccgtgatgtgggaaacagtttctaacaaatcttaacttacccttcttggtgtcttgaataattgggttcaatggctcttccttggtaatttccaacttggcattggtccaacgtggaatttcaacaaccatgttgaagataccattggcttcatcagcatacaatgggatgtcgtggaaagcagaaattggcttaccatccttttcaatgtaaaccttgtaatccaaggaattcttggcaccaacttgtctagtagtgtaactcatcgtgtccggtgtatatatacgtttggcggggggtatataaggctgtatatcaattgaagaacctaagatcatatatatggcgtcagtggccaatggtaaaccagtgcaggcatttttcattcctatttatatatgaattttgcaacttttttttcctcaggtcgtccactttgagagaacgacaggatggaaaagaagcagattggtgcttgaagaagcgatagtttaggaagtggctgattctgtgttcgtgtgtaggtgtgctagggtatacattagggtctgtatatatttggtccgattgtatacagttgcagttgcatagtgtattttttttaaagtcattgggtttaatcatgcttctctctttgtagtaacagagtttcacattaggggaaaatcacgtgataagagtgcttttggggaaaagccacacgataggtaccgcatggtcgtggcttgctgaaacggtaggtcaacgtacaatcgacgtgtgtactgacgaacaaacattgactgcaacacgataccattttacaatagtatactggttagcttatcgcccttttttattgaaccagtggttgtgtattctcacatgagcttgatcatctgattgtaaaagtatcaggtgtagttgtttttcttaccccatcaaacaagaaattaacagcttctatggccaagttggtaaggcgccacactagtaatgtggagatcatcagttcgactctggttggaagcattttcttttttgtctcatgtgagcaagagacaccacctgtaatatggcctcgctacctagtatacttagcccatcactgatgatttgaaccactactctatcctattaccaattaaatagatgtacacacacatatcttcagcatatcgagtcttcccttcatcgtatgaagccatcatccatcacatcttgatctatttcaccaccacccatcggaatgttgtgctgtctcacactcatcaacagtttctggaactcatcatggtgcatcttatttatcagaacgttaggcctcaactggaatccttgtctacacaagggacacaacccttttgatgtttcagtacttagccattgcttgatacaatgaacatggaaattatgattgcataatcctaacacaattggacatccgctaccagggtaatcacaggaggggcaagtagcatcgtaccggttacgacagatcccacacacttcatattcttcttcatcgttctctgcatcctcatcttcattctgtatatcttcccatttttccatatgtaccgtttgatctgcaacaccatgtttccctttcgataaatccttgggaatatcccacgcccaagtgctcactagactgacatctgttacctctatacgcatagtaacacgggtgaagtatccttatcgcaggctttatcctcgtcacagttcccttcgttctgtctttgtgttttcaattcttcctatctaatcctttcttataatatattatacccatatgcataaaagtgtcacaggttctattacaaatttaataaagggatcagatccactgtagtatagtatacgaatgtttatatatgttataggccaagttttaagtcgcagcagcagctttcttcacggataaagtagatccggcccatgtcttcaagctctgtaataatgaattatcctcatgtaatccagcaaattcatcgctaccaccacgagatataccattgataataacgttaggaacagtagaccttcctgtcttgctaccgatatatttctgtagttcagctccattctcatgcttatccaattcaacgatagtataaattggatcaaattcatactccttcaacaagttcttgagcctcgtactgaaaggacagtaactcttagaaaacaccacgattggtgattgagaaaggatattcttgtactcagcttcagcgttgtatgtttctacttcagcagcgaaatcagagtctttcacaccgttgggcccagccatatttttaactgcgttgctggtatcagcaacaaccgcgttactcttggtttcagcaataccttcttggatattgttgatgtcactctcgaccttggcatcattcgcgaggttgctagattctttccccacgtaagaacgcgtcacggactctgcattgtgcctgatgaagaaaagaacgaaaatcaccataccggtgagacttaccagcctcaaacttctcttactcaacatctcgtttcaacaacgcctgggatctgataatctatgaaagtgtagacagacggtgtgtccaaaatctaacgtgtcttgttcatattgtttcatcattttaaggttgtatgtgacaagaaccaatttcttaaatagcaagaaatttcactatttcattcttgaccaacagccgtatcatcgataaataagagagaactaaagaaacaggggaaaggatggaatacctatgggtttgccggacgcattaaagcataaatagtgtataaataatactagataccacccgctatcctgaatatatgcatatttatatttaaaacggaaaatttactggaaacataacgcgtaagattttaatttgcgggcagattagatgttgttgaattaatgattgtttttataaatattatagtatgatatgcggtaaagtctgtattagaattaaaatgaacgataagatcagttgttaaaacagtattctaaacttcaattaaagaacaatcaggaaagaaaattagaaagaacatgaaaaagaacatgcagttgtaatatgtttgatgctgggaacgcttcggcccatcgtcaatttatgactttgtaattatttttgtctttcctttcagagttaaaatcttccttccatggcttctgagtgactttctattaggtaaactaatctttcatttacgtagttgcaaatgatgccccaattagattctagtttaactgctttctcgaagtatttaaagtgtacccttttatcacagacatactctttgaaagttttgaacacttctaattcaagatcgtatccgttcattcttttcaagtttctgtaagatctgatatgcttaccatcctgaatcaaatcctgagataatgcaagttcaacggggtcgaatttcggtagatgggaatgaacaaacatcacatcgaccggatcatttgtgaaatacttaccgaggtaattttcttgataattatactttggatcgtagtcatcgggttcgtttgtatatttggttccgatttcgttttgagcttgacgataccttttgtaatcctgggcgaaatcgtgctgtaacatacaaacgccgcggaaaccctcgttattatgcctatgatacccatcaacacggggttcagaacgtacttggtagaagggcaagtcatagaaatgagccgcagcgatgaacgtttccttgtcaccttcacctgaggaacgctgagagaagatagaatagtaccacgatggcccgtaaacgttatagtataacgatagtaaaaccgttggaaaatgtttcagtttgttgatcatcaattgacccgattcagtggaagcatctggaatagttccatcaagatcatgtagcggaacgtcagacaaatctttcaaatccttggtatagactgaaggcggagtgacatcgtccatggtgttacggattctttcgcttgagataggtgtattagcaatactatagtatgatggatgtgtggtacgtctccagaagtcaggccataggataagaccagtatccttataggatttttcttcaaagatcccatccaatggtttgattgggaaattgtctgcgtctagtaatagcaaattcttgaagctggatgcgatgatagccaatgatttgaattgataacctttgaaatcggatttttctatcaagtcaggtgggaaagcatctgacagatagatacacttagcgttatactgaggtaacaagacgttacagaattcgtcgtcaccttcatcactaggggggatgaaaacttctactggtaaagttgtgccgaaatttcttaccgttttaatgataaggaaagccatcatcgaaaatttaccaccaccaactgtcactataccgtctccactatacgtatccttgggcaacactaatttactcaatgcatgaacgtaatttgaatgggcctcttttaacatcagccgttgttcttgagaaagttgcaaacagttgttcaactcttcagtggtaagtttccaccactggtctgtgttctcttgcctatacccaatatcaccgttcaaactacatttttggttataagtagcaatattaactccaacaggaccaaattccttcaaatacttgaaaacttgaccataaaacccttggacctgtttcttctttgaactgggggtagaacttgcgccaacgttatcctttacaacaccatcattattattttcgttataatagttattattattttttattttatcgccattgatcttgttattactatcaccattggtattggtctgtgatccttgcttgtcaccctgctgttggctcgcttcctgtctcgcatcatcgtacgaagagcctgtatcctcatactcttcaatgaactgctgggtatactctttcaatgaacttgtataatcattggttgcaatttcagatttcaaataaacatggatactgttcaacaccacgactgctaaagcaaacgcaacaaccactttgaacactttctggaaacgtttcgtagtaaacaccataacagacgtaaaaaaaaaatttgatgaatgttattccgtctgatgagcttggcaactatttcccgtattatttcttatttcaatcgatgagaaacgctgtaagaacaaaaaaaaaagtgtattaagcactcgccaaccactaacaaagccaataatcaaagcgaacgcgtaaggactcgaatatcgacctcaaaattgaaaacaacttgtcagttaagtttctaaataacaacaaaacaaaaaaaaatttgtattggacccttaaaatccaacacaggaacaaaccacaaataagatgaaacgtggattgtatgagaatacctgtacctacagctaaatatcaaccttaccacgcattaaaaaacgcgcttttaaacaattaactccacgaaagatcgccataacattactgttttttgtcatttgcctttatataacagaaattgtgttgatgttttttttttttcaatttcaaaaatagattttttgctgctaaaactaagcagagccaagatttgacatctccagccgaaggaatgtcatttacagccgtggaaaatcggacggtgcagaaccctgatgccttatttacgtacctacctatgacattatacactgtttacggtttatttcgtgtcttgtttccagtacaggggggagaccgagtacaggagtgaattgggggatttttacttccaactttatctgtgcaaagtcattagtaatgataagtcttttatcttcccagttcctattgatatctcgatgccctttttcgtacctttcttcgcaggctcgcgcaccgtttagggaaaacttgtgcaaccgtttttctttttccttttgtctcgttcgtaacacgtgcctggtatctcaggtgtttagtatgtataggatatctagttccctatatgttacggattgattttgacatctgggtgatttcagtagcaatgtcaccggttagttttgagtatgagaccgtttccagtagtttgttgccgttaccaaccgattggaccatatcagcgtacgatttgaacatcgggacgcaagtatctcttgtctcttttaacttggtctttatcagttgcttgacgcttttgtccttgatgcgtttcatttggtctagtgactttaacgttgccaaggtgattaaatagctatggttcaattcccatgtagacttgctgatttctggacactgttctattagcatcgccatggccttgtagtctatggcctctgtttccagggagttgtagagtaatttgatgagttgccaggtccatagttcgtgctgagacatcaattcgcgcaactcttcatcgtttgtggtaacgagtgtatcgtcgatgaacctattgcgttcgtttttagttaggctgtagaagatcaactctcttgtaatgctgatcttcaaccatttggtaccgacgtggattggtgcaagcaccgtttggaatcgggtcacatcgtctgtaccaaaaatgtcaaaatctctgttatcgctccagttttcgttgtggaagttgttttcgccgaacgtgttcaaactctcaatgagtggtttgtattggtcaagtttcttctcgttcaatagcctggacatttgcaacgtttccaccatagcgtcccacctggtgaacgattggaagatcctctggtaaaattctacgattccaggtactttgcaccaacttctacgttcaaatgaggcaactaggaacccactcatgttctttaacgatgaatagatcgcctgtggctgtaggcttctttgacaatacttgtagttcttgttaggcaggaacgtcgaggaacgtgtgaagagccagtggtttaccaaatcgttttgaacattcttgatgttcaacgtctccaaatgggcaatggctttctctggtaatcccagatacatgtataagagaacaagccataccctggtgtcatagttgaaggggtcttctgcttggtaaccttccaagagcgaaatggacgtaatgacgttctctaagttcactttggagtcttggcataggtctttcacgatttcaaggatgaaatacgagcagttagagtaatctgtctttggctttgttgacaaagattccttatgtttcaagaacaattccaaattatcacctttgccgaacaattgagcaacagctttgtcgtgtatcagccccgaaggcagctttgaaaacatggtctcgattttcactgggttcaattccaagctatgaagatcgattggacaactaggtttatcatgatatttctcgatgaactgaaacaggtagtgatctagcctatcgtcataaagttttgctgctgcgactcttgctagtatgtaatttctcgtattcttgatttccaaaacttccaataactcatcgaatgacttgccaagtttgtaacttgcatctataatcttttgcaaaataccataatcgtcaaggttattcaataacgagattccatgtttccaaatgagtttataatcgtctaatttcaccaaatggcccataaggaagtttttcaaataaaggtctaagtaagtaccatgtttccaaaacttgaggatctcgtccacgatctcctgtgatttatcctcaaacaattcacaaactttacagaaaacgatcaactcttgctcattctcaaaaggtttcaaatcgcttgtcaatttatatgtcaacttaggtaaaagatccaattccctttcgttaatgttatctttatccaactgaaaccatactacagtagcaatactgttccagaattggaacaatctcgatttcgatttttcattgactcgtggcatctggaaactactcttactcaaatgtctccaatttaaatccctcaatgactccaagaaccaatcataacatgtctccgaattaccgtatttcatcattgctctttcataaggttccaatgcactggtggtgtcaaaacctaattccaacaaaaatcgatggcacattgatagcgatttcgcatcgcttggaggagatttggcatccaagatcaactttaacccattttcaaaactatatttcgcaggagattgcctgtacttgacatattgctctaacactttgtaataagtggcggatgggtaccgtttctgcaatgatgcaacaaactgtgaagctttcttaaacagttccctatctaatagctgaaaaagctgatgatcttcagagttcatatcaacagtttccactcttcgtgttggtcgatatcaaatctaacagatcaaacagcaacgaacaccgttactgccagacataccgggttgttctacgaacgacgtgcgtatgaggttgttcattagaagtttgaatgctgaattaagccaatatcgtaatttttcagtcttgattacccggataataaactataactgtatgtgtatccataaatgtaaacggcacagcctaacaagggcatcagcgctcttactgcttgaaatataaacgcaagacctcaccatacaatccccacccgcgttgaatctgatagaagccagttggcagacgatacgaacattttcttttcgagaaactatccttttctattttaaatcatcactgatgagccttagtttctttttcggtacattgaaaatttttgaaaagttagaaaaggcgatgagatgagatgagatgagatgagatgagatgagaagaggtattgaacaaggttgtcctgatccttccaatctatacatcgtcggtctaaacactttgagattattgtattacacttgagtagttggaaggaagaaaaagccaagaactgctaagcaaatccttctataatgtcgagtattttcaagactttgtctcgtaaggataaagacggtaagaagaacaaaaataatgcggctaacagtgacagtaatgagaaacagttcatgaataagcaacgtaccttacttattacgtccagaggtgttacttatagacatcgtcatttggttcaggatttgaacagtcttctaccacattcgagaaaggaacctaagttggacacgaagaaggatctaggacaattgaatgagattgcggaattgtacaactgtaataacattatattctttgaagctagaaagcaccaggatttgtacctatggctatcaaagccaccaaatggaccaacaatcaagttttatttgcagaacctacataccatggacgaattaaacttcactggcaactgtttgaagggatccagaccaatattgtcatttgatggtagatttgattctgaaccgcactaccgtttaattaaagaactttttatccataacttcggtgtaccacctcaagctagaaagtccaagccattcattgaccatatcatgtctttcagtatagttgacgaaaagatctgggtaagaacgtatgagatctcgcatgaagctaggaacaacgttgaatatgaggataaagaagaagatgaaacgtcgttagttgaaattggcccacgtttcgtgatgacaccgattttgatccttgaaggttcatttggtggtccaaagatctacgaaaacagacaatacgtatcgccaaacttcgttagatctcaaattaaacaacaggctgccaaggaagctaagaccagagccgaagctgctgttgaaaggaaactaaagaagagagaaagtgtcttggctgtagatccattatccaacgatgcattgttcaaagattaaagtacaatccagaactctagaaaaaatcatgatttatatattgtcaacttaggagaacggcgttcttcctgctcagacttgtacatatgtatactcctatatatatgcttttgaatgggctgtttttgataatataatttttcgttttattcctaactatactatacgttaaagtcgtacatgaatatttaatttatttagttaacttggggggccagaataccagttaaacttgaagcgtcatgaaacgtcatggggaaaacgtttttacatttggtgtgaaccacagtgtgctgtttgaaatgttttttttatcatttgtttgaattttaatagatttattaatattttacttgcccaatgccattgcattcttctattccccaaatacgaagatgttatgcgtagtaataacaaatcatactgtataattttcaggaaacgtgaattgaacagtcaagtgggtagaattaataaggaagtaaaaatgtcctgacttttatctttagtgcttttcagcgttggcagtatgcttttccaagtaagccttgatgaaatcttcctcacccttagaggaagtagagtataatggcttggctggttgcttagacttgaatgggtttggaataaccaacaataatacagcacctaaagtccctagggccaattgatgtggttgaacagttctacccaaaattgtgtatgcagcactcatcgtatatcaaattattttcttggtctatattctaacagagtgaatctcgaacaaaggtgtataggataccactaataacgcatctgatccagtgcaaaagttcgctcaaaaccgccttgttctttctagtgagaagaattcgaaactttgaaatttttcagctttgagaaaggaaatcctgctttacacgctttttaagagtaaatcgctcagaaacagacgtagcatattcttcaacacacccatacacctcacacagtttactggaccaatcatgtaagagcagctcgtataaaactggtaaaaaccagagagtacacacagtttaacgtatgtttactgctgaattctgtcaactggatacggaagacaatagaatggacacataatggtctcaatacgacaattcaacggctcttagaaggtgagttattcttgacattttcatggctcttcgagcatgctttctaagatgacgcggaaggtgaaaaagattagaaaacggccattcacgtgaatatcacgtgaactacaaattcatgatatattaccgccaatagtattggtggttacccgatcgtatcgaatgtactgacttcgaaaatatgaatagtcctctttaaaacaaagggttttcagtgacccttactccatcatctccttagtatttggtctacagactgccattgccgtatattcagggtagtagtcagtacatcggtgtctgccatggtttcgataaagtttcttttatctttatacggctggctatctgtcactttagccatctcgttgaatgccgttgttgatagtttattctcgaacagtttcgacgggaataacaacatcgaggatcatgaaactgcaaattataacactcagtttagtgtcttcagctcaaatattgacgacgcttattcattgagaattaaacctttggatcccaaatctcttggcgttgataccgtgaaacaatggtcgggatatttagattaccaggactcaaaacacttcttttattggttttttgagtctagaaatgacccagagaatgacccagtgatactatggttaaacggtggtcctggctgttcctctttcgtcggtcttttctttgaattgggaccttcttctataggagctgatttgaaacccatttataacccctactcttggaattccaacgcttctgtgatattcctagatcagcctgttggtgttgggttctcatacggtgactctaaagtgtctactacagatgacgctgccaaagacgtttacatattcttagatttgttctttgaaagattccctcatttgagaaataacgatttccatatctccggtgaatcatacgccggtcattatttacccaagattgctcatgagattgctgtagtgcatgctgaggattcctccttcaatctatcgtcagtattaattggaaatggatttactgacccactgactcaataccaatattacgagccgatggcctgtggtgaaggtggttatccagcggtgttggaaccggaagattgcttagatatgaataggaatctacctctatgcctatcgcttgtggaccgctgttacaagtcccattctgttttctcttgtgtgttggctgaccgttattgtgaacaacagattactggggtttatgagaaatcaggtaggaacccttacgatattagatctaagtgtgaagcagaggatgattccggtgcctgttatcaggaagaaatttatatctctgattacttgaatcaggaggaagttcaaagagctttagggactgatgtgagttctttccaaggttgtagctcggatgtcggtatcggtttcgcattcactggcgatggaccgagcccattccaccagtacgtcgcagaacttcttgatcaagatatcaatgtcttgatatatgcaggcgataaggattatatttgtaattggctaggaaatctcgcttggactgaaaaattggaatggaggtataacgaagagtataaaaaacaagttttgagaacttggaagagtgaagaaacagatgagaccattggcgaaaccaaatcttatggcccgctaacttacttgagaatctatgatgctggacacatggttcctcacgaccaacctgaaaattcattacaaatggtgaattcatggattcagaatatcgcaaagagatctagaatataagcatatttctttacaattaattttaaatacaagcaccctgaggtatatactgtatgcagtttgttgcatatctatcatttctttcgcaattgttcacttttgattcattctgtacactctaataaggttttgcaacctagtaatgatttccacacattcttcagccgacacagcttcgaaataatatctccgttctctatcaggtctgtgaacaaaaatcttgaaatattctggaacgcgcttagaccttttcaccagggtaatttggcttatatggaacgatttcgtcttgacgttttcgtgtgtccaattgaaatcaccatcaggcccacttatataaacgtagtcaccatcaatgaccaacatcctctcgtgtttattgatgaatgacatttgttgtcttctccataccttatatttatagtaggaaccagcaaagagatctttgtaactgttatttccagaaacgttatttgatggtttggataaactcccaagtttaggagatttctggccattgttgagagaagattttgaggaatttttgagtttaaaaaagccagaggtagaggaagatgtgttatgctgcttgttgatactgaataaattctttgagcttgttctgttcgaggttggtcgaccactgttagcagaagtttcttcttcctgtagagttttattcaacaatctgttatcgtttgccattgttagcgttaatggtgttagttcagtactctgaattgttggtaatacaggttgattggtaacggctttcattctttcaaattttttcgttcttgcgtccttcttcttcaacagttccacattataattaccatctaagcttgtaacgtagtcattcaagtcaagaattaaatttctcttttccatttttaatacgtattccgttggatcgaggttcttcaacttacagtaattgactaatacttcgttaatcttggaagtcacaggtattctgatgtttgtgaaattgtactgaggattcaaattaggatacaagaacacttttatattcacatagttagaaccagaatcagacatttgtgtattcttagagggaataatcgatttgtagtaacttaattgattgagatgagacagcccgtcattgctatcttcttgatcgaagtcatcggtcatgacacttggtaagggtgtctcttcttcattccgttcaaactgttcatcgttcaatactttgcatatgacaacctcattatcaaatattgtgttgatctgctgagttctctccaagactccgaaattatcttcgtaaggttcaccatcttcatcaacaattttgagggtgaaatgattggggttattaatttcatctgtcggaagttcccctgccgtatcagggggtttgaattcggtcgagtaacagtataaactatatcccaatacttcaaaaacggttgctgtcttcttgacactaatagtaaatggcttccgtttatatgttttggaatcctgaatgtaaacatccaattttaaagcgttacttcgaagttctttctccgcagacacggcacagaaatattccaagggattgatttgtgtagttttgcttttgttgaagagaattgatagagtagactcactttgtgggtgattattaccaacatcaactttttcaatgacgaactccggttctgttgatggctctattgtatctttgtcaacgctgctttgagtggccactgatgaagtccttctatgtctttcaatgggcaaaaggtgtcttgacctgatggactctgacatacttgacgtcgagctgcgatgtttcatagcgcttgaacgcaattccggctgagataaattcaaacctcttttccccacagcaccggtactttctctaggttctgattgagaaagggattctctaggagccttattggccatatgcaataatttggtggccttatccaattccttatccaacgtcgaatcatcaccagaatggtacatagtaagtgcccttgatcttggaatggagttgttagggatctcatgagaatcgaaagtcattgaagacaaatctgacgattgaaggtgactggattcaaattcatctccgctgaaatcagaatctaatagagatttaccgtatgatgatgcatcatcattgctgatcaaatcctcatcttcactttccgaaataaagctggaagaattgcgtggaataccatctgatttgctgttaatagcatcagagtccgtattatttagagcagtttctattgtaatcccattctgcagatcaaagggcttcaaatcaggttgattgagatacgattcaatgtaagaggaggcatcctttccattatcatattctttctgtttcccaccacgcttcgcttgactattatgtcttctctcgctatcgttggaacttacggtatcagaagtttgtagtatgttatgtggattcaaaggaaagttttccaagaaattcgttctcttggtagatttaaccttctcgtccagagctaagctactagaggagctattgttccgcttctctttcccgaagaaattcagcacagcccccttatcgtattcatatttatcatcttcgtcatcatcgtcttcgtcgtccaaattatcaagaccctcattcgtgtacaggaaatggtcatataaattcaacactggttttttcaaagaaccagccctcgatctacctggaatgaacttattggccttactactagtgggttccttggatgaagaagacgtacttgaagctctaaataatcggctgagccgaagtcctgactttttggcggttttcagtttctcagatgccttagacgtgctgctttgcaaagacaattcgcttcctcttctatgtaaagtgctgaccaccttatgcttcaagctgtttgtatcgcctgcaccgccgccgataatagattgagatcgcgaccgagatcttgacctggaccgggattgtccctttgaactgctatcatgagacttatctcctaaagtattattcgaactggattttttcgcaagcacatttctaccataatcagcaatgccattcctgactctatctgttccctcttcctcttcttccactaaggaaaccatcgtattattttgcgaagcagagaacagattcgattcagtcccaatagaatgattcttcgaatgcctgccatatttcacagaactttccgcaataggaggggaatccaaccgctgtaacatattttcaccattctcatcctcatacagcttcaaagttgtttcagaaacctccccaaacggtttaatgatcctattcagctgatctctctcagaactctgtttcaaaaacttggcccgaagcttattaattatcacttcaacatccatgctaacccataaagactctaacagagaaaatcttagacagttttctaatttgtagtcacttatttgaaccaagaaaaacctacagcttgaaaactcatccttcacatgttttattcaattgaaactgatttctgattaaatcaaaggtttccaggattggagcagagctcccttattcagcaattcaagatcctcgaaagattttttttttgaaagtagaaagtcccccagttcgaaacccacgtatctcttaacaataattttatctgtaaaatttcttttcgattgacgagagatatggaaaactttaaagcgatgagatgagatgagatgagatgagagtaggatgagattacatgaaaggagattattttaggtttgggtttggctagcgcatgtgttacataactttaaacagagtctggattcagataagttgaaaacaattaaaatttaaggcatttcctgtttcattttgtaattgatatcacaagttccacaattaacagtattcttataaactgaaaggatcatacacatcatggttctgtctagtaattggttaagcttacagaagagtactgattctgatagcgtgaataagaataagggtggaaagaagacgaaaagtaattctaagaagaggacagtttccgttaaaaaagacaaacagtatgtcgacaagaagaagaagaatggtactgggtctaagatcatggatatggttgccaatatgaatagggaaatcgctaaagtagagcaagagagaacgaagaatacccatgcggatggtcagatgattaattctgaggataggtttgagtcagtgttgaaacaaaagttgaatgaagacgttgcaaagaaatctttgtcaagaacaaacggagtagggaaatatgtttctatggactgtgaatttgtcggtgtcggacctgatgggaaagactctgctttggcgagagtatctatagttaactattacgggaatgtggtgcttgacctatttgtgagacccaaggaaccggtgacggattggagaacgtgggttagtggtatcaaacctcatcacatggccaacgcagtgacacaagaggactgtcagaaacaggtctcaaatgtattaaagggtagaatattggttggacattctgttcaccatgatcttactgctttaatgctttcacatccaagacgaatgattagggatacctccagacacatgccatttagacaaaaatatagcgagggcaaaacaccaagtctaaagaaactaacgaaagaaattttacagttagatattcaagacggtgagcatagttccatcgaagatgcaagagcgacaatgctcctgtacaaatcggataagctggaatttgaaaaattacataacaaacagtttgggccttcaaagccaacccaggagtaaatctccttctgctgtaataccactgcattctcgtaaattttgaatagaaagtagaacttgctattttctacagatttaacaaagctaatcgctttctggaaccaaccaataatagttcaaggtggatctaacttgaaactattcaaaacgaccctcgatcaggaatcaataatttaaataaaagatattagtcttaaatgtgttctaatttatactttcgttcaatatacgtacaatttgtgttttatcgctctgatgcagaagatattactttagaaagtaacatgacagccaacttctttctctcgtaggtgataatagggttttccctaaccccagtcaatacatcattcgcaagttcattttcaaacggaatgcttttgattccagttaggcctctttcttcaagtttcttatacatttctttctcaatcattggcaattttaggtattctttactttttactgccatctttatgatctcaaatgataaaagcactgtggagctattattggaatatttcgataatcttcttaattcgttcaaaacaaatggatacagtttgaaagccgccttcaaattatgttgcatcaagtgcctgtaaactaacataaacctaactttaccttgttcatccgtagctttgcaggaaaagtagagagaagctttgtacattgtcaaacatgcgtctggactgaatttaactaaccaatcgagtaaactcttgtgtatcttatttctatcatccaattgaacaacatctgtatccatatcaacatcttccatacatttcaggaaagcagatggtctctgtaatataaatatgaagaacatgaatatcaaatagtcctcgtttggaccaaacattaattcaaagtagaatagcttgaagaaaaccactaatgacgataacgaagtagctctagtatatggaatcaaaaggcccttgcatatcaaactgatcataacgtgcgagaaattgctttcagtgactcttaaatcccccatcgcttcaacttgtctcaagatattctcaccaaaatttctttgagccataagctgtttgatgaggggttcaggaatctctcccctatccatcttttccatgctacccagagacaagtgttgagcagtacttgacatgaataacaaaccactttgataaatcatcatatttatagagaaggaaatgctgctggcaagccagaataatttaggcaacaatggagactgcggatcgacaccgataactgcttttgtgtaagtaaagaatgtggagatcacgaaaaagatctgttcgtcattgacatcaggcatggcaacaatcaccatactctgtcttaacaagttgagcagcaagccatccgatattccttccttcgaaacaatacctaaaatcatcatagctcgagcagataagaatgattgaacgtggaagacagtccccataatatactgcatatatctcgtcttccattgctccacattaatcagagaaccattatccattaatgacatcaaattgttgacaaaatgttccaaagtcgtaaatttagtcaaaaatgatgaagcactaaaattttgtaaaactctacccctctcttggctgaagccaaacatgatcttcattttttgatcagaaaagatcttttgaatctcataaagatttctgcggttatattttggtagactggcattgctcaatagggactgacaagcattcatcaaaagtttatgtagagataatctcatctcagtagacccaacatcgatcaacaatgatacgatatataaaacctcgggcatataaatatcgactagcaatggagaatcacagaataatgatgaacacaagtgaactaagataatgagttcagtccaactgttgacattagtttcttccttcaagttgggaagaaaagagtgagtaatatctataactctcttgataatgacgccagtgatatcgatcgtaggtgcccgtaataaaattttacatgctggatgccaatcgactccttctgcagctctgtccatacaatgacctacaacctcttcaattacttccttcaataggcaactatcatgcaccaaaacaggccagatatagtccaaatataatgatgttggttgattttgttgcacagtgagtttcaccaaacggcgaaccaattttgtagcaatttcaggacctttctgatcatctgccaagaatacgtgcttgctcaaattttttgcccagtatctcatagttctcaaaaggttagcaatgaaatgaagatcatgctcaccgttttccaataaatcgatgctatatttcaagtagtagctagtgagctcgggcgaagtctcagccaaagttttgattagaggctcaaaaatcgggttaggatcctcagagatgtatatatcaggggtttttggcaagagatgtcccatatttagtgaaaatgtggtatgcatggaagagagtaaattgtaggagactaccctaatttcatcgtcaccacctaatccaactagcgccactaacagcaaatgactaactatatctgctgtttttatcgcttcctttgagtgcctactggatatatcggagtattcattatcattgaactcttcaagtattttagcctgtgaataatagaacattttcaagatttccaagtacttgggactggacataatcaaccttttacgatttctcaattcaaagcaaaactccgaagaaactcctgttattcttgatactgatgtggaggccacttcagcgatttcataaacatcattagggttgattactattgtatctgaagcatctgatgctttcaatgtccaagcactatcgtgtacaatctgaaagtatttgttacccactttcaaagtgaccgggctgaactgccttttcgcctcgtcatatagggaaacatcatgcaaagttactctaacatcatgataaacttcttttgaataatccgataggcccaatgcctttattagcttgggatctgagtctgtgttgaggaaagacatagatacgttcatattctggaaaatgtttgcgtgagaattttgaaattctgtccaccattccaagtaaattggcgttggattgaagaaataaaaggtttcacaatttgctaaaccttcagcaggtatcaaattgaaaaataatgacgataatttcacaaacctattcttgggttgccgtacaccatcgaatccagtgcaatctgtcacaaagaaatgttttttggtcattaccttcgagtatatttgaaaaattaggtaaattagagtttcgacatcgtcattaccgtctttctgatattcacaccaattgaaaataacgacaggtagaccttctgaagtgaccgactcctgtacaaacttgcattcattctctggagtttctggacatttgacggcttgtttaatcataaattcataaagttctgagctagtttcagaatgctccctgatataggcaggaatttcgtttttgaactccatccttggttgtcccatcaaagaaagaagctcatccacagcttctgccgtttctctcacggtagctaaatcatcaaacgattttatatcctctatcaaagcgtttcgcatttccaaaccatgataatataagaacttatgaaggaaactgaactcgttaggaaggaccctgttttgcatgcggagattaatttttaccttcctattcttgtccgataccacagacaagaactcaaaaatcttattgctgcaattcttcaagaattcagattcagactctaaaattttccacttgatagagttaacagacccgtttgcgatattctgaattactttcgctagtgacatcgaggattttctggccttaggggtcaaactatcgacgatttcttctgaatccggacttactagtgcaggacagaaaaagcgaaggaacaaaaatgacccgacagcaatatcagcgtactcgggaaagcgttctgaagcactagaatgaattgcttgacaaattacaaaaaattgtggcgggaatgagtcaactgacccggtaattgcatcgacaacttttgtcatatattttttgaatagcatcaagtttcttggcgcgtcaacgtcatttggatcaagtttttcaacatcaaaacactctttcgaattgatcaactcctctaaaattggtttgagtatgttactcaaataatccattccctttaatcttgctaacatcgacaatgcacgagtagcgcagctgtttctcctcaaaatttccatgtgacgggttgcatttccaatctcttctcgaacaagttctgtcacaataatatgcgcagcatttttgacatcgaaaaagtagacaatggaactagccaatgcatcgatgtcactagcaggacatatacgacaggctttcgagagtaaagtaggtctcttcaaagtcatcaagacaacttcctcaactatctcatcacgctttcgttttgttctattattagatatgtcaaagctcgagacaatattaacgaaaacattcatgaacgctagcctaatatttctattgtttgaatatcctatcggagtagcatggtttaatccgacatcaacgttggcgataagaagattggttaaagaaatgatgatattttcattgagtgaggcaatcttatgtcttaaagtagaggggaagttttcaacgtttgtgctcttctccaaagcctttaataaaatattgaaataattgccaaaaaccactgactttgatctttgcaattcaatttcggacatcgattgcggagcttccaaaactaaatccttcgttaaatatgcaattgcctttgaagactcaatagtggtatcaatatatagatagtccatatcccgcttttccaggtccatatcacggtgagatttacttaaattcagtagatcgaactccttaaaaattgcactttgaaaccattgggtgacaagcctcaaccacctgttcttcaccaccatgtaaccagcaatgcatatgctagactctgagtgttggaatgattttaacatcttagacagatggataacacatttgaaatacttcggagaggatttatcgatagtgtcgactatccttaaaatatcatcgatcaaatttagcaaaggaagagaaactatgatgagtacttctgatgtgtcatctctctcaagaatcattcgaacaaccattataacctgctccaaaagaatgaaggataactcgttatccttctcaacaatattgatatcctttagttcatctattctctgtcgtagagctgcaaataacgcgtcaaaggccaatggatgtaactctgttgctaaaatgtcttttgaattctctcttgtcaacaaatcttcattatttagccatgaacactgttttccaacaaaatatgataccttagcctcaacacttttcttcatttcatgcagtaaagggaagtggtgttgtgttgagtcgtttatggtggagaatattccgcatgatgcagctagaaatccagcgtagtttctgaagtgactagtttctgaagtgctcaaagatggtttgagcgatgcatcgtaccatcttttatatatgagatgcgagacatcaaaaacaattttatctgggaacttgatgtattttaaaatgtcagttcgcaacctacgttgaaaggcaaccacacctgttgagacgtaattatcacgacacatgacctggaaaaattccacatttgcaaaatcaagttcatggtcatcatcaatatcatcaacatcatcttcgtgcaaaagttgatggattcttatttcttcggtgaacaacttgaaagcagtttttaataacttatgaattgctgtattgttggaataaagggagcagaataacgctcttccgacggaaccgcgtattagatgaaaagttaacgcctcttcttctaaaaggtcacttaagctatcattcatttcatatgtcttggcaatgccaatacgcgctgtccataagtccacaaggggtttcaataactgttcccgttttaggtctgaaagattcaaatcaaataatgttgtgcccataagagatagaaggtatgcagagccaacgtaacagacagagcgaaaggcagtgatatcaacttgtggctcttttagttgagttatgacagagctgataattccccgagcagtatcaaacaaagactcattgtcatcaacaagactcgcaaagaccggttttatggtcctattgaaatccctcaaataaacagttgtatcgctgtcctcgtcgtaggtcatgtaataatatctagtcattcctttgtaaatagaaaaaatgttgattaaaataattcttgcagactgtgttgtttcctgttcatgtctctctagagtatctctaatgtttttcacggtagcactactgatggactcttgagatgtttttctcagcatggagccaaccctgagtggagatttgatatttttgtctattattgtacgaattgtattggtggacttttcaccttcatttggagatgatgtttcccgcaaagaggcaaatgaagattttgatggtcgtcttgcagttggtgctactatatctcttaaattcttgccagcaatagctgcagatacaccctcaactggagataatgacgatgaagaagtagtagatgtcgatttcgaggttggtgtactatcacctgttcgtgagaaaaaattcataaacgctggagaagatgatggaagcggagatgcgttgaattgaattttttgatagcctttggaataatctcctggtttcagctcaaagatgctatctaccacttcagacgcatgttcatcgaacaaatttgattcactcaaaagaatgttcgccatctcgcatgcggtatctttcaaaaaatcatcaatccttgtcataattctgtctttggtgttgtgcatggtagcattgttaaaataaatacaaaatccatccgttatcattctaatatgagagatacctgagtgctttcttttgataaagtccgacaatttctccaagaaagcatccgcatccaatgagcaagcaacataaaaataatcaacttgaagcttgaaatgtgactgcggaaattttgcgagacaatgcgccaccattggatttcgcttagcatccttctctgagcccaattgtagcaagtcgcacatcaagaaaaatagtcttctagtgaaataggaaacagacgaatcggcttcacgaagtaggggcgatgtagaaagctttgaaatgagaatcaaaactctcaaagtgtcgagaatggaatattctgagatgatgttatttccattaatgttttttaatattgttaaaaggaacttggtctttttattcgtaacatgattcagtgaagtcaattgatttcttattttcttcaatccgaatttagaactccttgagcttttcaaagtcgatgatgatgaacgcgaaaggaatggagaatcactagatgatttatcatcaaaggcatcagtatcttcgtcagttcctaacgcatcatctggtatgtttttcaatgatgtgttattgatctcttcgaatatatcaggacttaacatcaacataagagttgcgaaagttaataccgatactctagtcatatcctcagtatcatcgttgagttcaaactgtggaccataatatggggcgttatatccggagcgtcctgaagacgtagatgctgtccttgagtggcccgaactcgactcttcatcgtatatggcatactcttcaaaaggatctaaatgagaagacaattcttgaggagaaataactgttggagacgtagctgatgagattgccccttcggttaaaattctctcaatattgaaactggagaagacatcttcaaacaaggaagtagaaatcttttgaatgttctgtaaagctggatctgaggaatttttttgaaggccctcgattactcgaagataatcatgaggtctggccattatccatgattgaatcgattccgaagcgaagtacaataaaatttcctgatgtattgatttcttcattcttaccaccattctttgtagtacgtctaaaaatgagggaagagtctcgctggtaatgtaatggaatgagaaatagcacaaatacggcgctatttcactttcggtatgggtatgcgccactaatagtggtgttattattaccgatctgatgaaactatggaattcgtgagggttagatgcggcaatgtatttgaaaaggtacgcacagtgttgatccaagacatctaccaagtaagtataatatttcgacttctttgcatcgctattagaattatccttcccctgtgaaggatacagagaggacgagctacctccgtgcagcgacttcaacatgctgttcaacatctttattacacgtttattagattttatccttgacaacaattgcaaaaagctattggcaatctgcggcgacaaaggctttggacgaatggtatgcaaactggccatctgcactgagtacccattgtaaaatctagaaaaagctgagtcgtcactcagactatagtttaatttatattccgggtccaagttcctccagtaaatttcacttgtatctgtgaacattcttaataaaacaaccaatgtcaacaagatatcaaaatcttgattcttgtctttcgataaattggctatctgctctaatttggctacaatggctggactgatcgcactatacccatgggataccaccaaattgaatagcgataaccttatattggtgaagtatgggtccctttcaacttcttcaaaagttttgacatgggaattaacgggaagcaaaggatccagctggctcaacaaaaatgctgtaacatctgttaggacgttatgggcttctgacatacttgctataatcgaatcgatacgttttaaaatccgcttaattaaaacaatcctagaatgcctttttccctaaatgtctaagcgatatgcgactatcccacctttcaaaataacaacaactatcgcgactcaaagatatagactggcaaatgtcctcaaatatcactcaataactttccctgccgtctcttggtctcttcccttgagcatttgttttgtgtaaaccattcattaagcataagcatttaaactggattattatatttgggagcgaaaacccttcacgtacaaaatgatactggcacttacatattttaagaacgggttccaaaggtttacataatgcatcttgattacacagccctatatccggagtattggagaacacgcaggggatcgcactacgttactgacgtcagttccaaagttaacatcgccgatacgagcataaagctatgaaataagatcgatgttagtttttagcatgaagattgcagagagataatatattacttacataataaaatacacatatatgcagagagatatatgtagagagatatatgatgagagaaggaaggaataacaaggtaaaagaatgcgaaccagatagggcgaagtagagtaaaagcagcagtggttgtacgattagtacaagtaattgatcggttcaattatggtaagaattccgtagtaagcgttccatgtgttcgacgtccagtctctgaatgaacaagttgcgaaggagcactatcatggtcagaaacgacgtgaaacccactggaacgacacagaacactgtcactttatagagatccaatcttctgcgttttgaccagcgcaattgaaattgactggcagatgatgacgatgaggaggaagacaatttcttctttcgcgatctggcagcagaaaaagttagtccttgattagacgtgccgttaccggtgtcatcattatctccagaactagagctatcatttctacgtgatgatgagctatcggaattgttggggaaagttgactgagatgatgaagcattatcgccgtagatcaagttcgatgtgataaaactctgccagatgtacccaccagtaagtagacaacttattaaaatccaggtatgcaaatggtatttccctgacggtgacatagctgccgtcaagagcaattcgaaacagatcatcactagtgacatagaaaacattctaaagatagctgccatcgtagcatacttgataatccatcttaccattagagagtccaagatcgagtatgagaggtacatggataccaagcaccacatggaagctagaaaatattcagaagatctagccgtggtcaaagcactcaatataatggtatcatcctcggtactagtcgtagtaccgatataagcgctccaagccatcttcatcttattcgttagacccgatgagccactatacagaacgtttgtttcaaaggataaagaccaagcctttgctagcgattgacacattgcaaaaatgggcggaagcaatgacacgtcacgacatagagctattaggaaatgttgttttgcagtgagatgagtgagagttagattcctcaatgaatggtgagatttatcccttcgaagtatcacggatgtggatgatttcttggattcaggacggttccttgcgccattagtacgactatccatcgcaaccagcaggacccccaccaagaaaccagcaataaacttcgtaccacccgaaacagatactgaaaagtgttggcctgatcggacctctgggattccttcacgacctgctaactgtacatatctccattgtggtgaattctgtatagaaatgtcaactgatatatatatatatatataatattaaaacaatttttagtgatgaaaatccgtggaaccgtctttaaggaaaaaggcaagatatcggatctttaaaggaaaaacaaagagcaacgttagatggactcgatcctattaacgcctgcaatcgttacagtttccccctatcttggcgtctgtagtaccataactctcaaagataagtaaagcttttttattcattcatttatataaaacttgtatacatatgtatattgagccaaaacaataaattctaccgtagagtctggtttcccgtcaaccgaggaatcagatgaagaagcacggactagaatatctaggtgagatgtgtatcttgtagaatttttttatctcaagcgcaagcgtatatgaaaagcaacaggactgttataaaaaagagaagatcaaaaggctccaagcgttcccttgtcataaaaaaaacgaactcatgctgttgcattagtttatgttggtatagcaatttgagacccgtatctacttcaagttgagtatccttggcatcagtaaggctcttattaccgtttgggtatagattcagatcttgttgatctgagttctttcgtttcgtattattagaagggaattggcgaaaggagggcccaatcataaattttccaaagaggcagagatttcgtccaattcggcctttgcagcatcgtacttggtttgtaagtcgtcatatttcttttccaaatcatctctttcttgttccaaagaggtgacttttctttccaattgctcaaccttcaaatcagcttctctcaacttttctgtggtttccttcaacttggaatcattttcctccaattcttcctccaattgttgattcttcttgctgaaattctcgttatgagatttcaaattggtagaatcttcagctagttgcttgtgttcagagacttgaccttccaaagtctcaacttcttcttccaaagtttggttcttggtagtcaaagacttgatcaagttttcgttatccgtcttttcttgttccaaaactttcacctgttccttcaactcttcgtacttgtcttgccacgactcggcttctaatttcaagttgcttagcttctattcgaacaaaaaacgggggcgatagcacccccgcttcactttccaaatctgtcacgttcattattactgaaatcaaatgcggatcgccatcaatcgacataccgtttcatatttcagcattaaagataatgatcgtcagacgaggaattgcatcttgttagtaattgcttaattcacattgatcaccggaccgagaggtaggggatcaagtagttatgaaaaatcgccacacatacttctctgatcttttccattgtagatgattcgtattagttcttgtttcagggagcgttttttgtgaaattaaaggtcaaataactcaattgttcactacagtaattgacgagtttcaaacaatcaatgggcactagtctctgatctgtaatcaacgaacacaccccatgtaaatccttcctgatgtaatgagtaaaaatacacgaagccttttaagtttgttattgtttttatattttcgattttcaggctttttcatacgttctggatttccaaaggcgggaaaccatgaaaatctgttgaattgataggatcgtcagtgagaatatgtggtttcaaagggtaacaaagtcagaaatgggcatttacactggatgcgatgatttattatgcgtatgtattatatatttgaatacatactagatatctggtatcgtgtcatttaacaaaaagccattatttcaagattcgactatatacgggctttgcacatagataaaaggtcggttcaagaaaaagaaaattaaaagttcgactagaccaggtagtttccttctcccagcagtctatgattttgtaggttatggatggattctctaaacgcagccttcattctgtcgttacctagtaaagtttttgccatccaagttcttaagttttcggataccgtttccgagatatgatgaatcttgttaccgtctctcccaaattggaatgctaggaacgcagatgataggataaccatgacgggaatccagaagaaaatcaacatcttatcgtttctgaagttttggcgttgttggaagaatctgttcaatcttacttgtagggcttcttcttcatcctcggacgtttctgaagtttgagaatcgtgtgaatccggagcagtatcgacactggcctctctgacgatagagaggctcaattcggtgaccttgttcttgcttgtgttcaatccagatactgggaataaatcttcatatttaggtagtccttctggagtacgagccgacctgtcgccttcttgctcttcaccgttatcctggcttaattcttccgatggcttgactgtcgtaccagtgccgtctgctctgtagggatgcacatatgtcgagagttgcaactgggattcccgctgagcaatggttagtgaagtatcgtcctgtacttcatcgtccaattcactcatttcgtcataaccactgaattcgtactctgaatcgtccgataatgtatcctgcaccatcttggaaacatgaacttggaagccgtaatcaacagagtccaaagattctgcatcgaatacgctggaatggaaactggaggtgcttgattttcttccaaacattttcaactcgtcttctaattcgtttttttcaatgccaccatcatgcgtggccaataagcgcagagcatcttcgatgtaggagttgtttttctctgcagccgaaacatgctgcgacttgtatagatcgagagcatcgacaccgttgtctgcccttgctgtaacgttggccttacattctactaagagttggatagccttgacatcaccgttgatgcaagcaaagtgcaatggtgtgaaaccgaatgaatcagtaacgtcaactctagcaccttttttgaccaaggcagaaaccagatggaagtaacccttcaaacatgccaaatgtaacatagtttgtccatctgagttacacatggataggttcgagccagggtttagcaatttcacgactttcaatattaacatttcgtctgagtagtatacctggttgctggagttagtggcatatgagtcagcgttatagttcgtcgagggcgagatgtttgaacttggtgtcgaaccattcgaggagccaccatcacttccaacaattctcttggcaatgtttcttgcatcttccaatttaccattcattttgagtcccacgatttgcaaagctagttcaatcaattgacgatcggtatcgtccacgtatgtaaaaatagccctactgtttgacatgttacccaacagttgttcattaccatgatcttctctttcgaaaacagaaactagtacttgacccggtttcgaagttggtggtaaatatgtaacgatggtactttcactccaacactgagtagataaagctctattgtcgccgaatttaacaatcatattaggtttgaaattggaacccaatagtgtcacttcgatgccacctttgataggaccttgagcaggaataacacgttgaataaatggttttgggccggattcgggaacagtattcgttgtagacgaacccatctgctgcactagcacgttaggccttggaaaagctgcctgttgttgttgtactggtgctgcgatacctgcagcagcaggtttcacagaccccatttgagataacaagtttggttgtttattttgtaacaaagaatgaggtggaccagatatcgaagaagaaacatccaaagctgtagttactgaggttgaagaattagacaacgagcgttctgacttattggtaccgtctatagagcttcttggacgtttataaccattcgttcttgccgaggcagctgcagaagagtggaaaaagccaggagtagtcgggtttactggaccatggtcggtatggacattttctgaagaatcctccgtaatggaagttggagagggcataccttttggtatagaaagccgtactggcgctgaagagtcctcagctttcatactcacgtaggattcggagttactataatcgctggcttgtcctgtcatagaatcttcatccttgacataaccatcgctggtacggttgtcactagatttacccttgcttgtcgtctttttatccataataacaatactgtttgtcactgttcttgccaagatattatcatctgcatctcgtagaaccatcaacaccttgaaaccttctggctccttatgatgtctgcagtaacatacgatacgggtcatcaaagagaaatttttagagttttcattgcattcatgttctttcattaagaggacttgtttgctattaaaaacaatagctctcttgttatcgttgttacaccaaagcagattatcacttacaccagatttccgtctcgcagctctacgttgttctcttttcacacacctggcacaaacgtatgtggtcttatttgttgacgagcaaagcaaaaaagtctccaaaaacaacatctgcctcctcacctcgatggggtactctgttatatcgtgagtcaaataaagcttctgtttcgttatactatctgtcggtaaatggatcatatactgtggaggtggaggggaaatcgagacgttgactttaatttgagtttccactctagatacagaggggattccatctacattcaatttgtatggcaatgagatatcatcatcatccttggggagaaaatcagttgggttcaaatataccgtcttgaaaggacgtgttctaccaaattccatcccatgggtaagtaaccgttcactttgttggtaatatgtaagattctgcattggcactccggtgttattactgctatgtttctcatctcccagtttccattgttcgacattttccctagtcaaatcgtcgtggacatctgtaacaccgccagaagcattcatctgatcgtcaacatcctcatgctcattcacatccataatttcatcagtatctaacttcaataaatcaacattcgtacgtagctggttttccatcttcacaggggacacaaaatccaatttgagtaaaccaggagaagaatcgtcctctatcgattccatcaacatatccttattaatatactggtcaaataggtctgcagcatcaatagcatcagaactactacttacgttgcgactgccctctcgagggccgctatcgccggcgctatccctagcttcctcatcgtttcctaaaaacaaaaaatcgttcaaaagatcgcctttagacgtgtcttttttctctgtaagcatccttgacttcagcaaagcacgactattcctatctaatagtaattgccctggttatattatcgctacactgaatcaatacactgttgatatggctaaacaaatacattctcaataacaagccgtgttatcatttgttaaatccttgtaaaactgttttcaaaattcaaaagttccaatattgtccgtctaagctgatgcaaaaccgacaaaaatccaacaaaacctcttcaaactgggctggaaatgtgtttttgggggataattgtgcggttcattctttacagaaggactacccttgatggtaagccatcatttttctggcggaaaatccgccagaaaaatgtgtttaccatcaacaattcccatcacgtgattgtttgtgtattgagtgtaaagaacatacgtttggacatgacacggacaatttcctcaccagagaagaacttttcgtgtcttaatgcatcaaaattgaatagatctcacttcattgtagactggtttccgttcaccttgactctttttctctgtttgaggttacttagtatggaaaaaatccattgcaattctcatcactggtgaaacttgatagcttccctcccccctttaagtactatatataacagttgttccccgggtcgtgacctgttctagtacaattcccttatcacactctcaccaaactttagtaaaaccaagaacatcacaaataatacactataccatggacaagtgcgattattctgatgttaagagaataccaatcgaatctggattggaaaatgaactatgtgccatcctatacacagaccaatacaaggaactcgtatcattattcgttgcattattacaacaaaatgaattatctgaaagagcaatggcagtaactgccgcggtgattgagactgtaccagcgttatacaccgcatggaactacagattcgagatttgcatgtccttgttccggaaagaagatgtatccgcatgggagaaagaattggattggctcgatgagttcaccttaaataacccgaaaaactaccagatttggtcgtacagacaagcgctactctcagaacatccatcccccaaattagtgcgagaccttcctatactagacgtgatgatcgatgacgatacaaaaaattaccatgtatggtcgtaccgcaaatggtccgtccaattcttcaaagattggtcccatgaactcgactttgtgaacaagtacatcgatagagacgtgtataacaacagcgcctggacccatagagctttttatttgaagaacgtcgatcatgttcaagaggaaggagtagcagaggtggaaattcaatactgtatggataagatattgttggctccacaaaacgtaagcccctggaaccatctacgttttatttataagtcattcaagaataacgaatacgattccaagttgattaattttgcttcgtccttcatagataacgccttggagacatataccgaccaagaagaaagaccaatctcccatgttaagtcttctttcgcattggagctcctagctgatgtatattctcaaacagactcggaaaagtccaagatcgcatatcaggcattagcagacacttgggatcctataaggaaaaactactggaatttaaaaatcagacaattaactatataggattgtattattaacatacaaggatgccttgtcgcgcaaagggctcccacatccaagctcacttggctatcctacccgtcggtactacagaagtatcatatcatctctaccttcactgacacaaatcacgtttctttccctcaactagactggaaaaaaattgttccaaggccaaaaagattaaagaagaagaagcgatgagatgagacgaggtaaagtttaatgagtggacgggaatcgcctcagagagagatattagtaccggcaagtattcataaataatcagctacaatcatctgcaatggcgaatactgaatctgatattacaagagtactaggtgggatctatgttggtggtattcaaccaattgcgaaccatgttccactgaaagtgaattatcagatcactcacatcctatcagtgatcaaatttgagatcattccagaatacttggtcaggaagagttatactttgaagaatattcctattgacgataatttgagtacagatgtgttgcagtatttcaatgaaacgaatagatacatcgattcatgcctgtttcccgatgagatagagcttgaccgagtgaaggttgatttcaaaaagaagccccaaaagggtgccatatatatacactgccaagcaggtgtatccagatctgttacgtttgcagtagcgtatttaatgtacagatacgggttcaatttgaagacagctttacatgcagtgaagaggaaacggagcgtagctgaaccaaatgagaactttatggagcaactgaagctgtatgaagccatgggttcgaatatagtggatgtcgagaataaagactataaacaatggaaattacagaattccattaaaactgatcccttgggagccaatatcatggctcaaaatgaaatgtataagtctgaagaagttgaagctgaaaaggtagctaagttatcgaaagaggaagtagaagatgtttctgcgatccgttgcaaaaaatgtaggtttagacttgcattttccacttctttcattaagcatgatcctccaagtaaggaatcaatggaaggtcatttcattaggagggccgcaggatctagaagaattattgatattcaacaatcacaagaccgttgttcgcactatttcgtggagcctttggaatggatgaagaaagaattacaaaagcaagagcttgaaggtaaatttttctgtccgaactgtgatagcaagatcggaggttacaattggaaaggttctagatgcagttgtggtaaatggatgattccggcaatccatatccaaacagctaaagtcgaacaaatagcattaactaggaaagacctacctaatttagtatcgtttgaagaataatggtctctcagtactcgcataaatatcattcataaaggttagcattttttattttatttgtttaatacatgtcattcttctttaataggcatttaggtgaggctagatactcgtgaaccttgagcaccggagtctagagtatcagatatggtcaacgatggctgttcatggaccgaatcctcattttcatttacaaatggcagtgcatccacatttgaatgcctggatcttgaccggttggtataacttgtatcaattaattgtgaatcctcaacaaacgtacctctcgttctgtcgagcatagatccttgttcgtgaacttccgcatactcgttatcgtaatcataactttgatcgtactcttcttcagattgttcaccaacttgtgctgtcagcagtaccgattgttctgtatgttgatgattatgatttgacacaataaatgaagaggaagtttggtaggcattaagtattggttcttgccctgaattgtgttcattttgttgcttgttctgtttacttcccttctccttttcgatctcttttagggttttatcaatgccaataggtcgcaaacttgagtagccaagagatcttatcagcaatagtgtcgatttatctagaatgttaatggtattggaatcagacacatctccgtcattattggcaattaaaggtttctcactatggcaagtatacgccgcaagaggaatcaatctcttcccaggcttgatccgtctcttggtatctttatcaatgttccaactcaccggtttcccttttctgcttgtcttgctttgcagaagctcttttcgtagattgtttatcaaaggaatgttattgaaatcggatggtgcagaaggttgtctgaaggcatcaaggccatacataaactctccaagccccatatcttacttgtaaagcctactgtctccaaaaatattttgtgaacagcctcttaatgtctgttattgccattgacacagtggtgtttaacaggacacaagtaaatcatgatttaaaggttttattttaaaagaaatagaaaaagcatcaacaaaaataaggagagctgtactactcaccaattaccagtagttaaacgccggcgtcttgatggcattcactccagttatcttatatttgatatgaattgatagaagacactaaaaagaactgaatattatatattagtatgtatgtttgaataaacgttattggtgtaactacaggttacgctttctttccatatgatccaagaacttgtcaaaaggagtctgtttcctaaaataagcacttctttcagccatgttagccaacttatcgaataagtattctccccagtcaagataccgtttaatataattcttcaagtcagacatttcataagcgacaacataattgttacttctacgcaatccagccaataccatagacaacaacgctaagtcaatactgtaatgaactatatctttaacctgattggaatttgataaatgcagttaagattaccttttagttagtaaatcaaagtccgttgatgaaaacggtggtgtatctaaccaccttcttcaaaaaaatgaacggtacgtacacccatgattcttattacaaatctcaaatatgtcagttctttataaagccagagtaagaccagaaaggctctatttctctacctgcaagtgactaacactattgatttctttgacagatgtcattacaatttcgaggaacatttaaatttaaataaaactgttaacaccatcaagaaatattaccaatttggagacaaaaagagaagctcaacgggacaccagcggtttagcaacagttctgtgattatctaaaagttagctgagaaaggaaatatgactgttagcatttccaagagcaatcttctacgatttgagcctgtgaagtccttcagagtttctgataaagaattgggacctataacttcagtgacatttgatgaccatggccagtacttgttgactgcaactgctagtgataatatgcatctatatgatgcagtaagttgcaggtttttgaataccatcgcttctaaaaaatacggatgtcattccgcaaagtttacacatgcgcaatcagaatgtatctattcatccactatgaaatcgtttgacataaggcatttgaatcttgaaacaaacacataccttagatatttccagggccatggtgctctagtgagcgatatacaaatgtccccgttggatgatacttttttgtctgcatcgtatgacgaatcggtaagactttgggatttgagaagctccaaggcacaggcccttataccaagtttagtccccacatgcattgcttacgatccaagcgggcttgtgttcgccattggtaaccctgagaaccatgaagtcggtttatataacgtaaaacatttgaaggcgggcccatttttagttataaatgtggatccaagctttgatcagtggaataaattggagttttcaaacgatggtaaatatttgttgcttgcgtcgtccgctggaaaacatttgatcatggattccttcgatggtacacagttatttgaattatcaggaactaaacctttcccattgagagagttcatggattctggatccgcaacgttcactccagatggacgcattacattgggaactgattacactgggaagatcgcgatatggaaccacgcagacttcatcagtggtaggacgctcaaacctcaaggatttattaacgccgcaccaaatacatgtcccagaactattgcattcaatcctaaatatagcatgtttgtcactgcagatgaaactgtagatttctacgtatataacgaatgaattatactgggatctggatatatgacttcgaagccagactctacccagagcacccatctatttaggaatggcactcgacatctcgataacatttccatgttaccgatgacacaaagctgccttttaggtctggtcatcgcgacatttaatcttctttcatctttcaagaacccaacctcgaaattctcgttacttcttactaaagataggatgatgcactccttttctctaccttgaaatccgtctacggtagatatctcaattgcttgatgcttttcatggatgagttttttcaacagcgatacttgtgaattatacggggagatcacaccaatactttcttccgtaacaccagcctttatcaactgctcaacgtggtataatgccaaatatgcttcattttcgttgtattttgaagagactaggtggaacttatcgtctgcatcgttgtcattttcatcagacctttctggaaagtcgtctccctcagtatctaaccaaatacatgggaaagtagtgttgtcgttcgattcaacacctggtaaatctgctagcagttgtttcgcaacggagtcatctgctttcaatttcccgtcatataattcgttagaagaaaactgcataatttcttcgttcattctgtactgtacatttagcaagtacttaaattcgttgccgtaatgttgcaataatctgtcaaacacggtagtactcaacaagcgctttactttatcattatcttcagttttgatcgttggaggtaactgcttgtcgtctccagctattatgagtctttgcatatctgattttaaatgtgagattaaagggatccaacactgaggttctaaactttgtgaaacttcatcaatgatcaaagtattgaacaatttggattgtagatcatacgcactcaacaattctcgagaacttgaaccgtgtaaagtgcaaacgacaattttgctctttaaaattatattaattagcccacttttctctctctgcctcaattcttttctcaatgccttgacctcctgccaccctttcttgcgatctcttgaagatttgagctttttaacgctagcaatggtatcatcaatctctttcataatgtcttttaaaatcatgcccgagtctccctttttagacaatacgtcaagggaatgtgacaaaacttgtggtagtagccgagatggatgaccaattcttaataattcatcacctggaacaactttactaagtcgttccaagattgtatcaacggaaatatttgatggtccacaaaccaaaatcctttcccctctatcgtataactgttttatcaactctacaagggtatatgtctttcccgtccctggcgggccatggataatagatatttcatttgacaacgaatgttggatggcatcacgttgagattcattgagttgttcgttgtagaacttcacgttatgttcagggtcttttttaatgaactttctttcgtgcaacatgtattggatcaagatattgtcgggtattgaattgaactctgccaacttcctcatagtagattgcattctcttataagtaatggtattagtagtcttcaagagacacaacctgttgaacgagtataattgtacggcatcttggtctttagattcatccacagccaatacgatttggttgttggacactttggataccacggcatccaagtttaccgtttcatccttcttactctttgcctttgccgaaggttgaaccaatactatatcaccgactttaaaggaaccagtgttcaattccttggtgatggctggatctgcagaaagttccaagtatagtttcgaaccgatcccagttctaatgttatctaactgtagatggttaattgccaacccagctgcgatcaatttgggaagtggggcactagctagcaattttgacgtttgttctacatcttgttgctgctcatgggaaattccgtcaaggaacttttcagcgacctgtttattcacagagcagtcaccagattcacaaaccataactgtatattccccgtggttcttttacttagagtgaaagttgttctaaaatatcgtatgaatgttttgagtatacattttctatttcctttttgttatatggactttttatatatgaaaggtcttaatacgttgtctcgttaaaagatttgtttgttaattgacgtctgagctggagctgggccaggagagaggtatacgaaagaatatgaaatatgaggtggcacagggaaaattttttgtcatcgccttatcacataatagtcaaatcaccgaacttctccttgtaacctggaacgtcccatctacccttcttaaccatctcttccaccttggcatcgatttcaggtctagccttggtcaattcgtccacagtcaattggtcgaatggtctagcggattcgatgttgttcaaagtttccttcaagtccttcaattcttgagcgaccaacttttcagtctcagcagcattttcaatggcttgagattcaaaggcttcaatggtagacagttgcttggagacatcaacggagactggcttgtaagatttgtagaattgttcaatcttatcgacgacttcggtgttcttcaagacagatctgtaatgggagaaatcaacagacgtaggttgactttgcaattccaataactgtctacgggcttcatcgtttctcttcttgaaagaggacaattgggtggcagtcttaccagtcaatttcaaagaagaaatgaccttagcccagtctaatttgttagcggcggatttagctagagacatgattataatctggaaaagggtgaagttgtggttgtaaaatgttaaaagagataccgtaaagcccaaataaaaggagcaatatgaaatgcaatattaaataataataattaaataacagttaacaggaaaatgaataagacctactaacgaattgcaactgtcaaacttgtatcgttcagtgttgtagattgaaagctttaggaagcgaatgaaaaaagatatgtttggaaaacctgtgtagagggaatagttcaggaggtcgtgttatacggtgtgaagatgcgactcgaaagaataacctcatcgggaagtcactgtccgggtaacgaggtaatgtgttggcaatgcccaatcacaatgcgggaaagccaacaaaggaaagccgacacccatacacaatgaccgaagaccatcacgtgattagtatttgaattcctaatttgctcacgtgactctgaaattcaaatgtgtgaaaaaaaaaaagaggagctcatttcccgcccggtcctataccccatttcagccgccgtccggcgcaattctccaacatcacgcactggaacccgtcaatatcggtcaacaccggtcaactaacagactttaacacaatactgactccaatgccaagagtattcaggtatatatagaccatacgtactggcatggaacgaataaaaaccctgaacgtttccttatctgttatttcagcggttccaatttgatttcagaacctataccgacatacataaaaaaaattcgttgaaaacaaacaaacaaacaaatacctgtaaacaaatacatactgcaactaaacactgaaactagccaatccctgccatagccctatcccacccctatacgatgatcattagtatacgatagtctgaaagaatagaacaggaaacaagatattggaaaagattttgcaagacataggatagacgggaaattattagagatgagcgcaacagataatgggagtgaacaggataaagaaagatctgatagcgtttacagcggtgatgagaaagatgaggtaatagtagagttactgaatgataagaaaaagaaggtgaaacggtcttctctggcatgcaccaggtgcagacgtagacatattaagtgtccgggtgggaatccatgttccaaatgtctcaaggcgggtgttgcttgcgagtacgtggaacccaataagaaactaatcgtttctatgagttatttgcagcggttgcagaacgatttgagtatgatgaagaaggaaaacgttaagttgcaatcttcgctcacggaacgtaacgcaaaggtccagtccctagagcaattgaaacaacagtacgacgaattgcgatcacgtagtaagacttatctccatgctgatactactagtagttcaagtttccagccaaatcaggatacaaggactttaccagtgatgaataaacccgatacggatgtggtttttcaaaagaacagtgtccatgatttggttcatgatgatgaaatcgtgcccaatttctcagagaggagaggccgtttggtggaatcaaggacaggtcaagaatatttcgttggatcatcgtcaatgacattgtttggtatggagattctttccttgatccctgattcgttgagaaggaaaagagcacatttggataggaagaatcataaacgccttcggaagccaacaggagcatcacatttacctacttcgtcttcttcagcatcgttggccaatccctctttgttgaatgaaccagaaccagtcgatgaagtgctccaagaagaaggtaacgcgtacagaatcgtgctagctaaaaatgatgggaataatgatataagtgtcaacttcactttaccctcttattcatatgcaatgcttctcattgatactttcatcacttataatgatggttgtttctatttcttcaatgagggtattgtaaaacactatttgaaacagacctatgatggtatcagtagttttgaagatcatactttacaaacaatttggttttgcaaagtacttcttatattcgcaactggagagatgtacttagggactgcaaataatattaatggtaataaattgtcatctaaggaaactccgaagttgccaggttccggtttcttcgagcaagcatcggaaatctttagttgcttgttttcaagtggaagggtggaaaacgttaccaaagaaggtggtatcgaagttatgttgttgtatgcattttatcttcaagtggctgactgtacagtggcatcctatttctatttcggtcaagcgttaagagcttgcctaatcttaggctggcatgtagacgcacaaagagactctttgacaagatttgaattggaacatagaagaaggatttggtggaccgtgtacatgtttgaacgaatgttaagtagtaaagccggtcttccactatcattcactgataacactattacgactgaactccctgatgattttgacatgactaaccctccaccaggatgcgataaatatatctttcctgaggctgagtacatcacaaactgtgtaaggataacccaaatcaacgcacaaattctcaacaaaatgtatcagaaacagccagattctaatattcttccagttctcaaggacattgtcacccagttgcttgagtggagaacgcatctttctgattttctacaagttgatttcactcaaaagaatctcaagatttcaagactttgtaccaacgttttcactgaatatttccaaggtatgaatttggctatcagaccattgttgttccatttcgcatccattcagctcaaacaattcgaagtaactaatgcatatattaatttgaagaactactcaagaacaatctcatccttgttgaattgttctttacaaggatccatcaatactattaggtctttgtgggctctaatggatcagaacatggtcgcattatttggttatatggatagagaatacatttttacatctgcttgtacgttgatattgttcaacgctgcattcggtatccatgaccaaacgtacgagcatttggaccacgctttgaggatattcacaaagatgagaaatttaggcaataatccagctgggcttagacgcgcacaacttttaaaactaatgtctactctcgatttccatggtaaaatgactgagttgatcatgaaacatacggacgaattgaagccaaatttccaatacgatatccacgatgacagaaatgttaatatagtctcgcatgtctcaactgcgttctctcagtttggatcatcaaactcttcaatatctcaaacagaatcaagcgggaggctgcgaaacgaaattgcaatcgagactaacgcaacaaggttggattccttgaatttcgacgaaaactctgatatccaaaaactcttggatatcttagaaaacgtaggcaaatctgatgataagctttggaaagaaatatctgaccaggctatgtggcttggtaacaatatggattctatgcattctatggaaactgagaacagttttggagaattcaaagctgaagattttctttaaattagtaccttaatatattccagagttctatgcatttaatttatatatgtaaattaaggaacgattatcaaatattcatcttatgcgaaggattttcatgtttggtcttatttacaaattcttttggcagcattaagttcgtcgtggtccatccaatccgatattctttcatcctcctgagcaataataactctacgtgtggacaattccagattattgactagctgttgtttatcaacaagcatgttacggaagctcttattatttttggtattcttcaaccaagtattttcactttcggctaagttctttaagaggctatttttttcacagtcaccatatgccagcgatgcataaccagatattaacaatggttcaccaccgtcaattagttggatacggtacaaaatttcttggatcaaggtcttcaaacggatatgcaagtaaggagaattttgcatattcattaaccattcaaagcaattgttagctctgagtaatttgagatcagctggcagctttaaacccatgttgattgtctgtagaatccatgacagatatttgtaaaagttttcagagtcatcaaatgaatcgttatcagtgaacaaaacagcctgtagcaatggcaattcattgtttttgataaagggggagcttagaacccagcgataagccttctcgtagatttctgaggaaggttgaatcaaaagatcacaaatacgggatattgtgatccataccatgggaggaagaggggtaaaatttttatcaccaatttccaatgatggtttttctacagtgtataatattttagtaataagcacctcatagatacgtctgtccttaaattgacttgattcttcaatggagaataacagcccttcaagtatagatttagcaacaaacaccgtatcatcatccaatgacaaagatgcgacagccaactgtaaaatcctattatcaacgaattttttgacgttgtaaaagtacttagatgaatcttcttccgaggattttctgacgaactcgtcacaattaaccaaacatagcataacaaacaatggatcgtatatagtagaatgattttctcccaaagaagcaacttccgccttgtacaggttttggagtttgttccatttttcttctgttgtaccagtttggaacgaatcgggccttgggcgatgcgaaggaaaattattcaaagtgtttgatatatcattcatactaattgtaacaaccaacccttctttctcctttgttatcaactttaaaggcccaattaattcaatttcaatctcgcgaagagaatcaacaaattcccaactcactatctcgttagtccatgattgtccgacaatggattccattttgtccaacatggatagcaaaagaatgtctgatgtagttatcgatccgctgtagaattctaaaagtttattttgtagggcaatgtttgaattttcggtaacgtccatgaagaataattgatagagagctgaagtagttaaaagtttactatatttggagcccttttcattcaaataaacaagagaatcgttgtttaaaagtagctgtaatatctgattcgagttgacagatgatttatcggctttcagcaacagcacattatagtactccattaaaacatcattcttaacccagatgcttgaagaaactacctctagctgggcattaagaatggatggcttcactaatttccacaaatctgcagatgatttagtcataaacttcttagttgtttcaagaatctttgcaaagctctcagataacactggtttttcagcaaggtattttgtgatgtataagaaaagcttgttcaaccacgtcctcacattattgtcctcataacgatctacagccatgatgaaggctgcaccatctgctgtatatttcatcttatgttcggtgataaatttagtggcttgttcaatattgccagtatccaataagctgtggtgagtggttaacaaggccaaggatgctgacaatttataacctgaagcgctgttcaagttttccatagctatgtttattgcttccataatagcttctctatctgtttccttctgcaaatgcgtcgcaattataatcttggtagttggatccggaatctctgagtactggttggatagagagtttgtcaaccctttaattctcatacaagactctataaaaaatgcttcttttccgataatagatgaagctaatttagtcacgtcgacaatctcaatcttaacaagcttgaaatccagaatttgttgaagtaatttctgaatatctgaagtcgccacttcgaggattttcgtaaagatctcaacatcaacaatgacattttctactagacatctttgaagcaactgcctacaaaccgtttcagaataattatctatcatatgcaaacacttgataacatcttcggctgaaactatttcgcttaaaactcccagcgcaatggttctgcgctgtgatttttcagaagcagcaattgtcttgaataaatcaaaggcatatttgctgaattcatcatactcaatatcgagctgactataaatttgttgaaggccattaacaacgtataagaataagtcaaatgaatcgctgtctatattaggcaactcaccatcaaacaaatgagaaaaataacttttcttaacgacacgtttcttaaacttcatatcacctaatgcataattacccaccttggacaataggttatcaatagtttcctgtacctgcgtagaaagtaaactgcctgacatcgttttctttagacggaaaataatagcagctacatcaaaagaattcacagggaatctgctcattttgcttaacttcggggaatattgcaacaaaatgtgatcatagctagaagttgaatcatttgaaaacaaaaggtattccggagatgatactttcttaatgatctcgtcagtaaaggataagtacaattcgacaagattatgaggtatactttcaacgttagaaagtagatttctaatacctacttcagactctcctagcaccagcatatttctgaaaaatataagtaaccacttgacgataactgactcttttgggttatcaatttggacaaatttccattgttcaacaagtgtcaaaaggaaaggtgatagattctcatattgccttgccatatcaacatacttatacggagtcttatgacatctagaaatggcttcatccaatagtttcaaaatcttcatgtgctccgaggtggaaaaagaggaaccagtacttgacaaaagcgataaactattaattaaagctgaaattggagaacttattagctctttcatcttgaaaatattactgaactgtaccaaattgaatagtaaattcgatattctagaagtgacgattgatgaagcgtttttcgaagatgcgagccttaaaagcgatgtgaatagagagttttcgttatttgaggcattccaccacttgatttgggagttatttagttcctggaacttcatgaaattatcaaggataaccaaatccattcctgaaaattgatcacttttcataatatcaacatatatgttgctagctggtaaattgacgttgaagaagtttgggaatattttactatagtaattgaggataacggttaaggacaaaggtaaaattttgttagttggggattccgtgtataagatattcaaaactgtcgtcaaaacgggtaaatctggcaagtacgaaaaataagcatttaagagcattgcctttgaattatcccatcccttttcgttgtacaagtccagcactttatccaatttcttcaatgaaaataccaacaattgacttcccatctgtctgattagatttactttgttttgcagacatttcgtaagagctgttttcgttaaagtagaaggaataatcgactccacgacaattgttgtggatggaagactatcagaatctactgtttcgacgtattctggaatgggaagattgatcattctacccaaaaacaatgtcataccaaaccaataagctgtcatctttgggtcatgtgatcccatagatgacacgtacgttgagtaaggagccaccaactctgggacgttacctaaaatttttatgactgtattacattgtgtatcatcttcccatggcttaaaaaatgttaatgtggtgtataataacttgttgtgtaacttgaataccttctggttaattaccacaggaacgcctgacttcaagtttgaactatcctcaaaccaagaagttttgtcggtaaatacgacaccaaagtccgtatcgccaccatagatttgaaagaattcatctatcaaggaaacaatggctttatttggagaatagtaaaactcatgcaacctattcacaacgaactcatttaaaatcttactcttggtcatcttcctaaaactcgtttcttttagaatgcaatcaataaatagatgtagagattcctcgataagttcaacagagtccattttaaccatattcttaacccacgcggtcataattttctgattgtcactgagaatatccttccttagtaccgccggtgcgttcttaactagtgttatccaaaatttaacgaagttggacctcatagagatgtgagttgatttcctagtagcttcaatatctgggttatcaagctttcttggattcaaaaccttcaacaatgctaccaacgtcaaatcgaaatatgacaaaaattcatcaacgaactggcctttattaaactgtacaatctctgtcattaacccaaatactgaattcgttatcgaaggacgcagattattgatacctctgtaaagaactttacagtaattattaagtatatcacggataataacggatccgtattgcacaacactggtattcgaattcaaaatggcaattagttttttgagctttatagtagtttcagcaaacttagcatgttcattcacctgtgcataatatgaccaaccttgtgtgcattgcacagcaagtcccttttggaaaaactcagctacagggcggtaattattggaaacatcaacattgagtaaatcaataccgttgataagaatctgcaggtcatcaaataaaccactgctcacattactaacacttggaaggttctgtttccatttcctttttctggtccctaacatggagccgtcgtcgttattcatagcgcaaacacaatgtagtttctgttcaaaaaacgctagatattaacggcttatatatattacaataaaccagcacactttcttgaagttttaaaatgaaccaatgctactgtcttacatagattttagtaaaacaaagtgatgattgtatatgcccaatcgatgcgatgagcttgatcaacatttttttcttccattctacgctaaaagaaacaaattttccaaatatgacggggcgtcatgcgattttcacgtgacataattaattaatagtaacttatcaccttgcatattccctcacctgcttgtaagacaatccatagtcttatatatgctgctttagatagctgggatatgatacatgtaacaataaggtcactcaaggatagatattagcgtttattgttgcttattatgcaaattatgtactatttttacaaaagatataaacaatatcggttgacagaatgaaaagcttggaattgattaacatcgatgagttacttccagagttccagaacagcttcgtcaaatctttaacttttcttcgaagtacatcgtttaattggatccacgaagagagatgttcgcacataggtttttgaaagtctcaagaagagcgtattcagaagttgcaaccaatgcaaccaacggcgcaaagaagtccagatttgataagtcagctattaaaccattaatttcactattgatattcggatctgtgttaacaagtgtttcagcccaacagcagagacatgctgatatggttagaagatatgagatgaagattaagattctacaggatttgatcgaccgtacgaagcaaggcgatttcaattacaatgcggagaaggaactagaattagttaacaagctattcgctcgtcatgagctgggtaattctgttgatttggaaagagaagctaagatgatacgtgaacgtgcggccaaagagattattgatcgtgaaagggtaataaaaggcatgaattcacaaattgaagaagaatcactggaagatatctttcaggatatcatgaaagatatcgatcaaccaaatagcagcatcgcagctccgacgaaaaaattagatagtgattctatgaagaagggttctgacgatattattgtagataaggaatggctagattatgagagacaaagagaacagaaaagattagcattcaaaccttctactgagaagcatgttatcgtagagaaccctggtgaatacaacatcgcagcagaagaaactaaagtcaagagatttttgtagggtgtgccaactaatatctttgtaattggtgaaaattgttcacttcatttacatgacttctaaatgaatatatatgtatatatatatggttacaacgaatgaaacgaaatatatcagaacttaacttcatttgtgacctttgtatcatcatggaccacatccttttcttcgaggggagcactgccattagaaggagtattaattttgggtctcacttcacttcttggtggactctttttcaaatccttacgaggactttcatgggagtgagttgttccagtagcactagatggtgtaatgggattcttgtttcccttcatcttatcattgataaccaaagggatagatctctgaggagatttctcctgggaaggaggttctgaagagtggcttgatatatttgtactttgagtctttggcgttttcgaatgtgcctcaagtaattcattcaactcagtaaatgaagcagaaggaatgccaggcatgtttgcctgtaaactggttaagccttgcaaaatttctggaggtagatttttcaattgcttgaaagcggaattgtttaaattgtcaaagctcgcatgaggtgagccgaaatatggactttgtgagttgaaaaatggctgttgagaaggccctggctgttgctgctgctgctgctgtggatgagagtgctggttagatggtggattcggtgggttgtaactcgatgaaggattgtaaggtgattgcgacttaggtggaacaaatggttgggtagctggttcatcagttaacagacctggaatttgcgtcaacaacatatgaattctatccaatgcattaccagctctttcaaaactcctagatgacattcttaaaatccaaatatagttacgcaagcagtctctaaaaactaatgcttcatctttagtaggagcggtcacgtataaaagcgccgaaaaagttccaatgagcgccaagttaccagtggaacttgtataccagaatgaattgatatgttctgttttcaagtcacggataaactcaatagcagctattagcctcgtcttggcagccgttctacaaactggaaccagttcaggaggtgaatctggcgataatgttgaaatgatttttctgtgcaaagtaatttccgcagaaaagtatgcaagtgttaaagttgcattactgttataactacctggtgtgtagttactcatcgataatttgtgcggcaaggaatgataccattctcttaactttaattgtaaaggttttgccaattttaaaacatgttcgatcttagttgttgtcttaatagcaccaattgtataaaaggtatccatgatttctcccaaaataatgcttaaggacaccatttgtctgaacagtagttttccactattgaagtcttcatcagttggtgaaatgtcaagtatggaagagttcccaatgggacctagaggcctatgcgacggttgtttattgcgttgactactggttattattggcgatttatcagggaagtcgtcttctgtaagaagcttaaccatccagttccgacctaaaattagatgcgaattcctagattccagaagggctgtccatttatcttgagcccagacggcccatgctaatcgccttcgtagtccacgttcccagcgaggtaatctccagtcttgacaatcaacaccgaggccaagttcctctgacaaagcaacaacttccgaacatagtacccaattgttgggacattcactacgacaatgcaaaattagtaaacctgcttggacaatgcttaatttgggtctttcaaacacctcgtagaaagtttttaatgcaatatcattcaattgattcgcaacatctggtttaggaaaaccaatcaattgcgggtggaaatcccaccattgtaaagctagggaataaatggatgcaagaattggcgccgtgagttcacgataagatcttgagtacttctccaaaaatactcgttcgtgtagaatgggaaagtaaggatgaatcagtttaaagaaaatttcaaccaatattttaccatgaggatgcactagtttttccactaaatctatatcacgttcttgcttcaagtaaagttcttgattaaaatcgtctcttaagatgaactgtgcattgggagataccttgcgtagtgcgacattttttgataattgcacttgctcaatcttgtctagtttcatgtgattgattagattaatatcgaagatggatgtcgggcccacaaaataggaagacctgggatattgaatggaagactgagcataattaatttgacgttgtatgctctgttgaccagaagttagcggttgctgctgttgtggttgacctgagttcattccgtaattgaactgattgaaagcataaagtgacgagggggatgccttttgtgctgcaccgttgttgaactctgacgcattcctttgatagggatatggaggttgttcataacttgtctgagatttgtaccaattctgaattgcgtcattgtagtattgtatcggcagattgttagcgctatcactggtaagctcattattaggcgtgttactgttgctattattaccaccggcgttgttaatattattgttgatattattgttattattattactattagggttactgttattaatatttgtgttactgtttttattttgattattattgctaaacttagtacgtttcaacaattcatgcacatttatgttctcatccactctatcacgtttgttcatctgtttttgtagcacatccgccgccactttcccactcggtaactccgagaatgtacacttgatccccttcgtatcacatggaacacaactgtcggattcagggggaacgatacatttcgtgcgtctcctcctacaatgatcacatggcttctctgttagcgtattttgtgtccttacagaaacgttaggagatggtgcaccatttgtaccgcttgatgggacaaactgtggagaattcgctgagctgttagatctgttcaataattcttgataatgttgcaataacatatccaacgaccctttgtccatccctgaagaactcttatcttgctgctgtggctgagactgtattttatccggactactattattaccgttagtcagattattcagaatactcgtataatcatcattgaaattcaacatggagttattatgatttttaaacccaccaatattatcacgttcttcattctcttcacgcgcattatcattatcatcatcgccattatcaactacagcatttaagttaccgccattaccactagtagtattggtacccgaaaccttattcttcaagttaatgtttcttggagagctcgacgcagacgccgaacctgcttcaactgaagtggtctccttaccagttctaatactgttcccagcgtcctcagggttccctgtaccagaatccacatcttcagaagaatcggccttccagagagagtcaccaccattaacggatgctgcgcttccactcatcgcgctctttgataaacctgtcgaaaccttgatatacaaaagcaaagagaatagtaaagacagactctatctcaaacgctttacaccacaaaatccttcagtacaagagacttgcaccctaaaactaccgaatctagtcacttgaagcagccaaatacgcgtccaaggtccctaaatcaccgtccgatgcgttatcaacaaacaaacgtttatcttttcctcagtacgtttccatttattaaccttctttgttggtttcgaaaaatctcatatagccgggtaacaaaccaatggaactaggaacggttcacgtgatcataatactttgtttaactatacatggactatacatctatatatccacgagagttggcaatctagtagacgaattgttccaagtacgcttctgctgcgaatctagctctggcgttcaagaacaatttcatttcagagatttctttgtcgacctcttccatgaagtcgatgatgaattcgatcaatttctcggtaatcatagtctcggtgtgtttatttgtgatcaagaaagagatactatacccaggcactgggacacgtcttagcacgtaaaaattctctgctctttgttcgaggaaactggtgaatttgtgtaccaaaatttgttcaatctcatctgcttgtttcactttaatactcatacggacggagttgacacttggttcgattagaacttgttcgtgttcattacgtgcgatatgcataggttgtaatagaagttctgcacttgtattgtccacttcgacctcaggtctgttgtgtctttccacttcttgagaggagaagtttgatagattcaaagcagcttgcaatgagtaacgcactgctgttaagtatggacgtagcgattgagacatttttccttcacttattaactgatgggttggagaactgcagcttttacggtgacaatggccaaaagatggggttgcaaacctgtctttattcaacgttatcggttgtgatttggttcaaatagggtcaaaagaattaattctgaatgaaatttcagcacattaactggaccaatgtaagaaagaagacacggaaaactagaaattgctgggtcaaatgaggccattggatgccaaaaactgtggaaatgatggaagggaatcatcaggcttattttgtcctaagtttcaggtctgatggaggcattgatcccacgttatagcattcttaccacagcttaatacaatcagggtaacaaggtttatgatctaatattatgaattgaaatctcaatccaaatgatttaaactgtgttagcgatgggatgaggggatgagacgaccatcagttatccaagtgtctagatagcaattctccagccagaaacattttaatttcaaatgtcctggcaagagaccaaagatcctcaaggaagagtctattattataatgatacaggacagaccacttgggaaaaaccagaagagctattcaccgagtttgaaaggaagctgctgaaatatggttggaaaactgctcttgcagaggatggtagggtttattattacaagtcagacacaggagagactacgtggaacgtgccggtttttgagaacgatgataaccgtgatgagagaagtataccaaccaaatcgtctggcaaagctgggcaaccggatactgcatcggcagctgacaccaactctacacaggtagaaagtggaaaagatgtagatgtacaaaaaatcttgaaagatagcgagaacaaatacaaaaacgaatcagaacttttggttgtacgaaaggctccatcaaaggaagaagccgagaaggtgtttttgcaaatgttacaagataacgaagtggattctacatggtcgttcaataggattattcgcgaaattgggaacaaagatccgcattattggatcatagatgatgacccattgtggaaacaatcaatgtttgacaagttcttgtcgaacagaacagaatcggagttgattaaagagcatcaacatttggaaaaattcgaacaggcctttatagaaatgcttgagaaattgcccaacattcgttactattcgcgttggaaaactatcaagaggcagataatgaatgaacctatttacaagcattctgtcattgatgagaaacagaaaaagcgtacgttccaaaggtacatatcttcattacagcatgaacacgaagcacagcataccaaagttagaaacgaggcattaaaagaattgaatctgtattttgttagcatatccgatgatattgaccccagcaacttaccatggagcaaattcgctacaaaatatctatggggatcaccaagattcgattcaaataagaacttcgtatcaattacaaggagtgatgttttcaaaatttacattacctttgttgagtcaaagatggctgaactcaaaacggaaatggaaggtttgcgttctaagaatttcagatcagatagaagggcaagagaccaatacaaagctcttctcgacgaattatcaccatacattaaatgtaacagtacatggaaagatatatatccattgttgaaaagtgataggagatttacgaacttgcttggaagagacggatcatcggcattggatttatttcttgatagagttgatgaagccgaactagttttgaaagccaaatgttcggtagcgaatcaagtaattatctcaaagggtttagattttgatcacaattcttccgatgagattcgaaacttgctacagcataatacacatctaaaggatatgctgcctgaagacattgagatggtactacttcgtttgaaagaaattcatgggagaaggaaacaagaggcatggcagcgtgaattagaactacagttagcaacacctgaagcaaggaatttcgaagtaaaattggaagcaatatgttctgagaagagattaaataattgggaagatgtactcaaagagattaaagacgatgcattataccaaagcctaccgaaagatctcggtaaaatgatattcgaaaagctcattcagaaaggattccaatctaaaaagagacatttggaagaacgcaagtccactccaacgttagatttggattattagtgaactaacagccgtagtgccttaattcttataatgcatttagaagtgaatatataaattttacaagctctaatcctcactacttatcaacgaagaaagtgccaagagacctagaaggccaaatttggcatatttgttttcagagatccatatcgttacgtaacccaactgtggtatatatcctttgactgtccctacaacgtctttggtcttgttcaagtagtaattacctctagcatacaatggtacatcatcaccattgttattatcaccctttgttagcaatagctgctctccggtggagcgatcataatgttgttttaatactctgtgaacaattggtatagatttcccggcaacttcatacacaaccacatcacccacattattcttctcgttcctgttccacaagaacaaaatatcacctctttggaaagcaggttccatggatcccgaaaggacaacaacgattggagaatgacaatctgtaaatagagatagccccatccaaaacataaacgaactggaaagaacgtatcccaaagacaaaaacctagtcaattctagcctcaagttcatcgtgatgctaccgttatcaaactataacgtaattaccactattagaccctagttgatcgtctgaaacacggtatgacggcctgaataaacctctgttttatcatttccatccttaaaggttataatctggcgaacttggccttttcagattatttttttccgggttttgactatataaagactaagagtattaaaaggtttcagtaagactgttaaaaaaccttaaaaacttcaaatctggatagcttaccgtgcttactttcgtatttagattaactagttgaaaactgataagaggtgttactgtttttaagttttaaaacataatgaaggttgctgtgattggtgctaatggtaaagtcggtagactcgtttgtgacaaattaaaaaaggttgataattatgatccggttgcttttgttcgtactgaagagcaagtgaaatatttcaagaatgaagttggcattgacgttacattaaccagtgttgaggatagtacagttggtcagattgccgaagctttcaaaaagcataaaattgaagctgttgtattcagtgccggagcaggtggtaagagcattgaaagaatatttacagttgatttagatggatgctgcaaagtagcagacgcctgcgaggaggccaatatttccaggttcatcgtagtttctgctataaaggcagaagaccgtactttctggtatgacactgctttgcgtaattactacattgctaaaaacgctgcagatcattacgtgagaggaaccaacctaaactatacaatcttacagccagggatgttggaaaccggcaagtcaactggtaaattatgtaccttggatcttcttgagacaaagaaagattcatttttcgctattgaccgtgatgatgttgctgaagtgattgtcaaaattcttcaacatgataaaggaacgatttgcaagacaatccctttggccaacggtggtctagcgatagaagatttcttgaaaacgctatatgaatgagcccagatatgcgattgatttaaaagcagatcttttatgactttatatgacctctatttacctgacccttaattttatatctaaatatacattttggacggagtttacctggtcaacagtgaaagttcaaattgattttattacatttgacatgaaagaatcatgggatgtaacgaaatccttgattaattgttggaattgatcttggctagcggtagtataatttgcatgtttatctacaaatttcaacaatgtgttgtaattggcaagccattccaaccatacaaaaccatgcaataacgaatcacatagatcatcgtttttgttcctttgtcgaaagtcaagatccatcgcagaaccctttgagatttcatagaaattgactgatgatttatcaccttcgtaaccatccaaaatctctttgaaatcaggatccaaatcgaacttgaaaaattgtctctctttgccagatatttgatcatatattagcgatctacacaatgctattcgtaccttcttagataggacattagacgtaggatttagttttgacttagacttttctcttttctggattgaatgagccttgattagctcttcaattgggatgcctgaacatgtaaaatcaaccatacgcttcggaagcgatggaaaaagatggataggtaacgattcactaacaattctattttgtaagttagaataaagcacgtactccaatatcattactttgagaatattctctaagattgtagaagaagatgcacttcttgatctctgcctttcgatgaaataggcattacagctaaaccgcgtaagccaattagctaaatttagacccaatgttgccattacctccggacgtaatggtggtgtgatctcaccttcgttcaaattcacgaaatcacctgccaattggaccttgtacatctctttcaacatcggtctttccattcctttatcccaatgaaaggtagtgaatgcaaaatttgcaatccccaaatcaatacccataacttttaatccactcttggagtccttaagcttaagcaaagtgtttagcttgaccatttgttcattcagaccttctttcaactgctttttagtgcctgtttgaattgaacccaacatgagtccaagacttttcagctcataacttttgatcccatctagatacttgttcaataccttcaacttactcatactgagtgatcatgtggtacccccacctctttttccctttacctagaaactatttatgagatggtgccctttttgtttaccttttgaaggttgaagaactgattatcaggatctaagagatgagtacatctaacgtaaaagaagacatattagaagaatacactgtcccctggggtagaaatgaatagctatgaaattcgtcgcatgacgtgacgatgaaatctatggccctcaattgatgctgcaaaaccgtaatatagggttctacaattccggtgacggatatgtcacaaaagacaccaatatataggaatacttgaaatgtatatatatgccgcaagacatgccaaacttttctcatgaactctgtaatagaagagaagcactgccatctgaatttaccatgacctattatcgagaagttgtgaacgatcatggtacattccgtggaatgtacgatccctctgaagacacattggatatcatcgaatcgcctagttttgagaacgctagcaaactatcgctaagaagaatcttacactgcttgtcaccacggtctcatagagtaataagaggtccaggaattcacaaattccgagtatggctcaataagaaaccaatactttcttctccggagtccttagattcagaatcccatttcatagacgaagcgtcagatagttgccattacgaaccattcagaaccgtccctttacctagaagaaataaacaccgtactaaaatcactgaatatagccacagtttgaggcagacggtacggcaatggtttcaccatgatttaacttcgcaaaaccaaacgtcaaaaaactatcatcatctagacgagtctacgatggatagtgcatattccaattccacattggctgatggacttgtagattataagacgaaacgtcaaacatattcaccgacacaaaccttcgatggaccaacagcacttatgtaatgatactttaaattacttagtaagagtgataaataaaataaaatagggatagaattataattccagagaataaactgtatcacatatgaagcacaattagtatattcgttttcgtcgttgttatacagtagagatgcaccaaccagacgcttggtattgtatattttctatccgtctgtctgtcttgctcatgcctcatggcctacaacatctgacagcatcggataatgggaaattgaataaaaaaataattatttgaaattccgaatgatgtataaagaacaaacacatgaaacgatgggatacattcaggaattatcgatcattgtttgatattttggtcactagttatactgcatttagtagactgaatttgttaatcgatatctgaaagccatagttatgcctgaaggagtgacgggggactctgtgaagccagtatccatcttgactaaccggtcaaactccaataccagcactgtttccgatgctggtgaaggaagaaatgtaagtttaggcaagatagaagagatttctggacgctgtggaccagctagacacccaaattatgaacctgtgaacggtcacgattatgtgaatccccagaagcttattcaaaagttgcagttggtgactaagtcttctgagaaagaaggcgaaagggattcagacagagatgtacttggtgagagaagagaacaaggaggatcacatggaccgttaaggacacccttgactgcaacatcagtatcattcacggttcccgagcatcaggataaagtcattgcgcataggctttctatttccacaagaccctcatcgaccaaattgggcactccaaccacagtagcctcttctagcgaagctcctcccaccatcacaccagtgaattctatcagttccacaactcgtgaaccggacacgggtcatgttaccaacacgtcaacggcggctactaatactgccaatacttctggagctggatcatctcgtcagaactctgtgcacatacctggtgatttcatctatttcgaagctaaaccaaataacgggacgcgcaacggtggtgatggcgcagtgtcccctaaaatgacaggtgtcctggaccgtgaactatcaccctctgccacgtctcttgattataatgaccccatcgctgccgtcgccgccaagaaggctactaccaagaaacgaatcagtgaagaggaaccacacgttccttttaccgaattgtttcaaaaagaggatgatgaaaaagtacatattctaataggtgcaacggggtctgtcgccaccattaaggtaccgatgatcatcgataaattgttcaagatatatggggaagacaaagtgtcgatccagctagtacttacgaaacacgcggaacatttcttgaaaggtgccaagatcaacaaagaggtcaagatatggagagatgaagacgaatggtatgggttcaaaagaatgggagatcccgtattgcacacggaacttagaaaatgggctgatatcttcgtaatagctccgctaagtgcgaataccttggctaaactagccaacggtatatgtgataacttattgacgtgtttgctacgatcctggaaatcgaacgtaccggtgatgctcgcgccagcgatgaacacatttatgtatattcatcctgtgacgaaaaagcatttgaaaatgttacaagaagattatccatatatagaggtgttaaaaccggtagagaaggttttagtatgtggtgacatcggaatgggaggtatgagagaatggaatgagattgtcgaaatcattacgaagagacttcatctaatactgggagaaaccaaggaagatgaggaccgtgatgaagagggacgtgatgaggacgaagatgaggatgaagatgaggatgaggatgaagatgaggatgaagatgaagatgaagatgaagatgaagatgaggatgaggatgatgacgacgacgatgatctttacgaggaagaaactagatctcaggaagatcaaacatccaagaaaagtaaatgatacacataactattctcttaagtagatgatgacatagcttatttttaaagttttacagttagttctattacaataataaaagttcatctccaataccatggtaaagctcgcttccggtgcttaatgaagccaatggcttacgtaccgcgagaaataaacttttagcgacggcacgacattcccaatcgggtaactacaaccgctccggctcctcaaacttcaccatagtatatatatatatatatatctgaaacatgagatgcacggatttttttcaatgcgcttcgatatgcccgtacccattgtcttgtctctgtatctacatagagaacaaactttccagcaaacaggcggagtaagaaggaaaacttgttcctaatcctccctctttcgaggaacctaatcagtgaatgagtcgtatctaatcgatataagtacttctacctttctttctttttttttttttttggctgtaatagatagagatcatcgacattgaacataaatttcatcaaggtaaagatttaatcttatcctgagtcctggtttttcataataactagtggggaaatctgggttggcaaatctgagttttgggattaatatacctatttgggaatctcgatacgatgtaccataagaaccttttgatgaatataaataagggtccctttttcaactattcaataggatgttggtaacttatacgttatactatcacaatgatttgagttcaccgctacaacgaaacaaaacacaaaacacaaaacacaaacactcaataccacaaaaatgtcaacacaacacatttttgacccagttaccgatactgagatcagaaccacttccaagcttttgaaagatttgaacggtgatgccaagttgcacttccttcaaatcgacagattggatcctccaaaggacaaggctattcaatacttgaacattgaacgttacggcggtggtaaattgccatacatcccaagaagaacatatgcttattactacatcaatgacaagatgcctttgttcaaggcaatcgttaacgtcagtgaaaaccacgtgatctgtaatgtcgaaaccccagaaggtaccattggtccattgttgccagaagacatggccaaggcagaagaagcatccctaaagcatccagcagtgctcgcagaaattgccaagttgaagctagaccaagcttcctacaaccacgcaaacttgggtaaattaagttacaaagtcgtctcagaaccatggatgtacggtactgattctccaaatgataagaccccaatgctacaatgttacatgtacttgaaactagaccatcccgatgctaaccattactccgtgccattgaggttttcaccagttttcgaatacttgtctttgaaatttgttagaatggattatttaccttctggtgctgatgaactatacatcaaagaaactttaccattcaaggcaatcccaactgtcgaataccacccagacgtcatcgagaacttccaggaacgtgaaggcttgaaaccattactcatccaacaacctgaaggtgcctctttcaacgttgacggtacaaagatcacttggcaaggttgggaatttagagtcgctacgaactgtagggaaggtttcgcgttgtatgatgttcacttcaagggcagatccttgatctatcgtggaagtctcgaagagatgaccgttccgtaccttgacagtcgcgctccgtaccacaggaagcaagccttcgatctaggtgattgtgggttcggtaacactgcgaattctttggctttaggctgccattgtttgggtgttatcaaatatttggatacaacaagagccgacgcagatggtagtccagttttgattccatcaaccatctgtatgcacgaacaagactacggtttgctattcttgcaccagaactacagaactggttctactgttgcaaccagaagaagagaatttgtcattcaaacaatcgcaaccgtcgctaactatgaatatatcatcaacttgatcttcgatcaagctggtgccattacagtgcaagttagagccaccggtattttatccactatgccaaatgatgagggatgtgtgaccgattgggccactccagttggcccaggcgttaccgcagccttccaccaacatttactttcattcagattcgatatgagattggacggtgataagaacaccgttgtgtacgatgactacttgccaatggaagagaacacagctctaaatccatataacattggtgccactcaaaagagaacttttgttgaaaaatcgggttccatcgatcaatctccattcactaatagaacatataaggtgattaacgaaaactcaatcaacccggtaactaagaagccagtcggttacaagttcgaaatgccagctaaacaaatgatcttggcttctaaggattcatacaacgttaagagagctcacttcgcaactaaacaaatttgggtcaccaagtacgcagaagacagaatgtatgcagctggtgaattcactaaccagtcgaccgaagacaccggtctaaaggtttgggcagatgggtctgaaagcgttagaaacacagacatcgttgtttggccaactttggctctaacacatcctccggtcactgaacaattcccagtgatgacatctgatttcttgcaattcttgatcactccagcttcgttcttcgaccgtaacccagctctagatgtcccacttgcaaacaacaacttcaacaagtctgtatattatgaagatgctaacaaggcggacggcaagccatcgtccgagtgttgtaagatgtagaagtggttgataaaactaaatattaaatattccctgtgtaagcaattattgaaaaactatgaaatgagcaactactaaagatccatcaaatgagcaataattactgtaacgcacttcccctacttagctggaaatagttcaactattgaatcgcatttaatacaagtaagttcaattgtattcttagccaaagctgttgccttgatttcgtcgagttctgccttgcacgaaatccacgagcacgatatgtgtggaatctaaaagcgcatccagcgcatattctttctgggttcatcttatcccaaggaaccagtgccggtgaactcttgaaaccattgtgacaaccataacatttttgtccaggtttagcctccagacgttgccatggcttcacattaggatctctatacgtaacattcttacatttcacgcatggaaaactttccacttctaaaccatctggtaagcttccttttacaagaggtaaaacttcagtcttgtgcaactctgattttgagggtatataattgtacttgttatccaaaaaccgcgttgcggttctcgtataccttgcatggcaactatcacatattctatttttatctagctttgaccaaggcaatcgataccagataacttcaaatgttcttccacacgagatacagttgcccggagtctttaccctaacgatctttctcaatcgtttggttgtatcttggatcgtaactccctcacagttcaaacattttaacgcagaagttggactaggactaactccattctcttctctgtacttttactttatagtctttacattgcctctattgtgtataaaagtgcaatccgtgtttcgacatctataccaactgaaccgttggtaatggtcacagttggggaaatccgtttcccaaaatataccttgtcattataccatgtcatggatgtatcagttttgcaactgttgcaatgacctttttttcgactttgattgtacaaatcttctcttcggttatcaaataccacagtaccagcacacttgagacaggggaaagctatcgtgggggttccatcatcaaggaatgacttgatcgaaccctgcttcaacgctgtttctctttctgccttggtgaccacagaaagacactctttattcgagcacatggttctggagactctgaaagtacaataacatttctgacacattttgataacctgagaagatagtgtcaagtttccattccaggaagctggagcccatttatcgagcgagcatttacaggaacagcaattgtatgcctcctgcttagtggaagtcagtattatttgatgttctgtgagataaatattattttctgcaacacggaagtcgtatgaacgttcatattgcccagtatctgtgcattcaaaagagtataatgggttgtttatagcaatagggtctcgtctcaaaaaaggaccaacaccgtagatttcagggaatgcacccttgacggttgcctttctgatacatccagatctagttagcaatgatttaagcatttcaatattgaaaccaggggtaatgacaatattgtaagtgtcttgaatattccaaccctcccttgatatgtgggctggtataaaagaaatgctgatatttaaccccaatgatctgcatattgcaatggcaccatccttgatgggattgtaaaccgatcagatagagatatacgagaagggtctcttatctgaataaccatcgctatccatcaaacctgtcattaaggactctctcacaagtggttcatcgtagctatactttttggaaagttcttttccttgtttactataaactcgagattcttgactacattccagaatggaatgcctgttgtcaataaccttaacttcccaggtttgttgaataaaaatgctgttgcacctaaattttccatgcaatttaccattctcatactcaaacccagatttcgccgtaccttttcaaagtctaattgacatcgtgatcttctttgtttaatgcaaacattgaacaccttctatagccgtcgcctaaccagaaccctaaaagccatgccaatgccccgagctcccgatcactgataggtttgttgaacaatgattccaattgtgtacgcataaaggaagtttgtttatttactgcactcaattggattctcgtcttctgcctgattggctcatgcaacttgtctatccttatgacttcagcagaccatgaaatattgtgggcatctgagctcttttgcatgcggaacaatgggggctcgtcactgatagccaaatcttcagtctgagcacgtaagagcccttcttgcattttatcgtgtatttcttgttcactatcaagggcagcttgtgagtcataatcttttactctttcagttaaacggaaatcgtttatatcgtcttcgagatcttcttcgtcattcaattctatatcatgaacaccactgtcatctgcattatcaggctcttcatcaactaccactatatcagaagtgggaacgataccaccatcgttctcatcgacagcagtatcgtcagaatccacggtggtattaccagctggtatgaccccaggttccaacagcctttcttctggattacgtctatcctgaaacattccttcaatatacggtttgataacatcaaagcttgagaacccgaacatctcaaccttatcatatcaaaggaagcaaaattcacatctttattcttatgggcacgatgtggactaagctgagtgatttcaaacattctttcatggcagttaatgatgctctgcacgaaattggcagacccatctgaggacaatacttcttcctctatcgtgacatcttctatgggctttagactgccatcagccatgaataccaaagtccccgctgcaacactcattatatgatcagtatgcctttaacccacctagtgccttgctatagaacaacgataaagtaggttgaaaaaacgatactctaatcattagattctgatgaagagatttatataccaatgaattagccgctgaagtcactaataagggtaaacgaaaaactattggaacttaaaatgacaaaaagatgtagagatgaccgtaccgtaccacaggaagcaagccttcgacttaggtaaatgtggcttgccattcttgcaccagaactgcaaaaccggttttaccgttgcagaccagaacagggggatttgtcattcaaacgtccgcaagcattaccaactatgaatatatcatcaacataaccttcaataaaaacagttctatcatcacagagaatatcagagcaactggagacctagctacaatatcaaataatggaacctatgtcacggatagtgtcactccgataagttcagatgttaagcaagcttaattctaagcagagaagatctgcgtctccaagcacacagatgaaagaaagattatatgcagctcatgaatccaccaaccagtttactgttgacgctggtcttaaggtttgggttgataaagctgaaagcgtcagaaacacagacaatgttgtacgaccaacattagcattagcacacgctccagttattgaacaattcctgatcactctaacctcattttttttcgaccacaattcaccactagacgtaccattggccaacaacaaattcaaccagtcggtatccgaatgaggccagaagtagagtttaatcctcgaatctagttaattgtttaatattccccctactcatgagaaaatatcatgtctgaaagtatttagtaatcgtccgcactacataataggttggcagagttaccagggtagctgaactggttgccactcataacctatacaggacgctatacttagtgtgaaagatgcctaattgacaactcgtattattttcctttccttcatttccaattttcttcagacaaaggttatgagaaatagtctgaaacctaaaaagctcatcgattgattctttgacataaaaaaaacagaatacagggaaataacttaacaacagcacaactccttgggcgttcggactgcgagcttcgatacaataggaaaatgcttccccctcgacaaccaggatgttctaccctagcaccaccgtcagggtcggacggcccaaagggcagtggacgatctaaagttgcattaaagccaggccatggtccattagattggcaacagttacaacaagataaagggatgaaaggtgagttagtatacggagtagggtctcctattccacctttcaggatacaaccaccgttacgtgtaaataaagaagcgttgaaggcaaataaagataacttttggtgtgttatcaataggaaagtgtactgcatcaaagcatatttatcataccatcctggtggcgaagtgatattgaaacagtgcgcgggtaaagacgtaacgtctttgttcaacaaataccatcgatgggtcaactacgaacggctattggagacgtgttttatcggaatgtacgttggatctgcggaaatataacggagaagtcgtatatgccttcattacttagcgtaactaaagatgcatagagttttaagtgttaatgatggagtcaaaatcttgaaataaagaaagggaaatatatacatacatgcatacatatatatatatatatactttaaacaacaggcgttactcaaaaagcaagtcctagacacagaaagttcagtattttcacttcttttcatcccaagggacgtttctaaatgtacaatagttaagaaaaaaaattaccaataaacattggaatgtggttgtcgttttgatggagatagtaaaaaaaaaaaagagggtatggtgaggtgaaattggatagtggtaagaggtgagattcaaaattagacgcataggtaaggtgcaactctcagtttaggaactgtcttcaaaagtcttttgatattttatttcatttttgattattctggtggaatattttcttcctctttatgataacgatggtaacaatacaatacaatacaatacaacaaaggtatattccgtgtgtaaattagggagagggcagacagggttttaagttggaaaaaaataaaaacgcaaacaaaaagacggtagacggaatcattctgcagcagcttcagcttcatgttccgcataagattcttcccattcctttaattttaacttgtaggaatctgtgtatttttgtttggaagggccgtccaattctctccatttttcaccaatcagtttggtgatttcgatcaaagtcttatctggttgttcttccacgagtaatggtcgtatatcctttgtgaattgtaagaagggaccggaaggtctctttggaggcaaagtctcctcgtatttctttctagcgattctatatttctcccagttggtcttaaattgatcgaagaaaggtttcttttcctcgtcggtcatagatttccatttggcactcgataattttgatagttctggcacttttgcatcagggtattgctttaaaagttctggacgaatcgagatggagaacaagaaataagcggacgaaggtctcttgggaccttgtttcttcaattctttacgttttgcgatacgtgtttgagtaatggaaagtttcttgacaggaggttgggcagttttcccggatccattggtggaaggagatgccgacccagcggatcttttcccagatttgggtcctggttgattaccaccgcgtctttgagcaccagcaccacctggaacgccagccgcgttaacagcaccgctaccactaccgccgctttgaccacccaaaaactggaactggcttggtatttggacctgagaatccattatctgttgctgtgcgtagtacctaggggaaatctgaccagcagcctgaccataatgctgttgcatggaagcatgggcctgggcttgtgcttgagcctgggcttgagcttgagcctgggcttgagcttgagcctgggcttgagcttgagcctgtgcttgtgcctgcgcctgagcctgagcctgcgccgcttgtacctgcgcttgctgctgctgctgagaccccggttgattctgctgtctttgattaaactgcgccaagatctggttcaacatcgcgtcagaaacctgatggcctggcatgggcatttgcatctgcatctgcagcggtaaagacgacacgccctgttcagacgaattcgcgacaccacccatcgaattctgaggagcaaagtagttatggaattggtactgcgaataaccggcgccattaccaccggccatcggatggcctgcgccagcttgagaagattgaacgccagattgcgcagggactgaattcgagttgcctgaattcacctggccagctgaatgctggccactcaacatatggtaagattgtggtgattgcacttgcatggaaacgggcacgccgtgtccttgctgcgcgtgttcttgttcgccagaatacatcaaatcctgatgttcgctatgtccttggttattgagattcatagtcgcggtaagataatcacggtataaacttcagtatggtatcttaattcctgaaataatcaattaacagtcaaaagtaaaatcaaataacaaacgtcaataacgtatcagcacctgcaccgttgattttcaatgtttatgtctgttgtctgctctttattgtttattgtttatttgttctcagcgaagttctgctaattttcttttcaacctggaaataaaccgagaaacgaaaaattctgtgaaaaaatgggaggggcccgttttcccctagaaggggtcgtagaggggaagaagaagggggcacattacggagggtaacgggctgtttctcagctcgttactatctccttagtatatcctattgctctgactggtggattggatccgatccagtcgctttctgtcctgtattatagtatggtttcgcgtgtctgatcctgtcgttttagaagatcgtgtactgtacttactctactcaccttcctcacaaaacaacgtgaagtcgtgatctctcttctttctatatatgtttctctgatgtagcagctctgctctttgtactgggaagcttttctctctgtgccgttccttgggcaggaaaaggaaaaaaaaattactcactgggagagtgctagacggaccgaggttgaggttgctagacagatgtctgtctgacaagctgtctggcccgtctgttccatccattctgagttccttaagacagggccttcggccctgtctttagacggttcttagccagggggagtctggcagcctcatgtgataattacacaaatctatgtacaaatggtttcctaaacgactggaagaaggatcagaaagcattgcatgttgtactcttctagaaacccattcccgtcttcactgtagtgttttgaacgaatcgtaccaaacaggaacactatccttttaaccagtatttctccctccctgggcttaattctcggcagtagctactgaactaggttcacctgatttagttctgccatataagatgttaatcacgtgtgccatggtaagaggtggagaggactcgaccaggataattacacgacgtagctctgtggaaggcatctaacatgtattaaagagaagcacttatcccatacttatatatctatgtactcatcatatatcatctcatatatcatcctcgtcactcgatgataaaccttgatgtgtcgaccccaagaattgagcaaacgcctgtgatagttgcggcaacgcagaggtgtctggagcctgttttgatatgaaattagtaatcctcgttgcaaatccgagcccgtcatagtcatcgtcatcatcatcgtcctgtttgttttcggctgaccctccagtacggggattacctcgcctcgtttccaccattcctcgcaaataatcatccatttgccttaaacggtcttgatctaatgaccagttcgaattcaagttcacagtctccctctggaaatttgaatgaagcaattcatcacgcagttgttgtaattcttggttattctgttgttggaatgctgacaatgaggacgttaatgttggtctacgatccgtatgggcattgctgcctgaacgactgtgggtacgagaagcaggtgtggtatcattgctggaactggttcttccaataatatcggcctcctctggtttgatcaattccaactgtctggtattgtaactcccacattgctggcaacataaccctaagatatggtaatccaccatagactttttgcgacagtcgttacattgtaccttacatttccaaaaacaatacggctcaggtaacctgtaatcttgaatctcttggtgtaatatcctaaactctctttccatgttaatcacagagacattacagttgggacacttatatgaatgtttgatatattcatcaaaacaatgctgatggatggcatggccacaggggtccatataaaccacagccatcgtactggtgaacatatactcgcgacagattggacaattcgaccttgtagagttctctatacatttatggttccccaataactcaatggaaagacatgcatcacattggtcacaatggaagaaatcttgtcccaacccaagtccaagtcgacatatcccacacttatcacaatggtatatatctttagtctcgtcattatcgtaaagtatgcatattgggcaatagtataatgcaaattcaatgccacaatgatcacagtgtgttgatggcgcctgatagtggaaacaactcgtgcaaagaatccattgcgtcgcctccctttggaaatgatggtcatcgatttcttcatcatgacagaaccggcaagatacccacttgttacattgactgcagagtaacttacagttccgctggtaatgcggacaccctcgaaccccaggtatttggtctatatccttcttatcctcttcagtgggttctggcggatcgaaattgtattccgatacatgattacccttagagaccagctcgtcagattcatgcgaatgcgaacaaccggtatgctcgcttggtacagtggcatgcttcatcattagcgtttggatcatggatgccttttgtgtttctgacaaatcaaccaacgctctgatttttttgatcctcgaccttaacgcatcctcatcctgattgaattttacatcccaatgcgttaattccgtatattctttatccattggcatcactaaatcgttcgtgtacatcgtcggatgcatcaccgaatgaaccttagtcacaacagtaggatcggtatgctccggaccctttatctcctcattggcaataccgataccagcactagccttatcctttgaatcagtacctgattcatcccttgtaccttttttgccatcgtcatgcggagaagaacttccccgttctgcatacgaaggtaggttcagtaacatagtatcccacctcgccttgagtgtctgtaaacgatccagcgccccgctaaaagtagcacccccctgcaagtctgacataaaactatcccattgaaacttcaacgaaagccgcgaaagatcagggaatcctctgcccaacgtctcccaatcgctatcttcatcaccgctggaaagactcatttataatcttctgtgcaccaataggaaaccttgataactacaatgtcagaaaaatctcttattccagtcttgctgcatgtaaagcaataagatatggtgtgtattctaaggccttttacctatatctcctctgatcaactgtgaaacggattcttcgaaccttattgtaagtcgagaaagtggtgattctcatctacacacattttttcatgttaaagtaaaagaaagaaaaaattaataaaggctttggtagaatttaatgtatatctgacaacaaaagaggtttgaatgccaagttctggatggttcattgattgatatcttcaagttgttatactaattgaaagagttttttcatatatttgactgctgttgtactacccacttggtgaaaaggattactcagcgcaatttttgtgaatatctttactgatattataatacacagagtacgtgaaagaaaggggaggtacatttaaattccaattgttatacaaacaacaatagcaaacgacatttgttcatactaattggagaaaaatggtgtccgtgggttttttgaaatcgatgtttaacgtttcaggcatggtagccgatttgaagtcttcaaacttcagtatttacggtcaatggatttcatacttgaatataattttctgtcttgcgtttggtattgccaatatcttccatttcagtgcagtcattgtattttctatcattgcaattgttcaaggtttgataatattgttcattgaagtaccatttttattgaagatttgtccgttaagcgataacttcattgggtttgtcagtaaattcgacaccaatttaagacgtgccttgttctatttggttatgtgtgctattcaatggtgttctattatcgttcaaagtactagtttaatcgttgtggcggtcggtctcagtattacagctacagtgtacgcacttggtgctgctgctggtcaagaattcaagaatagtgctattctaagtgaccggggtagagttgctgcatcagtgacaaacgaagcggttgttagagacatgctttgaactagtatgaggagaggttatataccattttatttcttattatgtatgatttttgtcagtataaaaatgtaacagaccctgtctgtgtttcttcgaatggagattactaaataattgttacatgatactaccaacgcggtgttagctacacttgctatctactatataattcaaacatcttttcacctggtccttgggcaaagcgtttgaatccaacatgtctctgatggttgttgagggttcattgttgattagacaaattgtctcaccagtgcttgtggttaccaagttggcagtattaccagacccgttgtttacattcatcagtataccaaacaacgtgaattcgtgtaggagatactgtgtgtgcttcagttttaaatgttgaagcaagttgtccttacgtttatgtgtggatgaacaccatgggcaatgaaactttttcacgtttgaatgagacagaagatgtctctttaaccaagattttcgtctgaattgtttctcacatagatgacactggtacgagtgatgcgattcgtgtggtacgccatcatgagtcaactgttgctgttgttgatcatgatcttggtcacgcccgttattaggattggaaagaagctgttgctcatgggtattgtgttctttgaaggttgagaaggaatcttcaccagttcgaatgtttaaaggctgcagggccgttgaaggctgtatattgtgagaaaggttttgggtttgagcttgaagtttgacttgcagcatttgtaactgctgcaagttatgcaattgtttataatgttgcattctatcgattgaatgcacggggacggcagggtgataggcctgctgcaaattgttattattactgtactgatagttcgtggtattagcagatgtagaattagaggagaaaatgcgattagtctggttactttgagataaagggaacgtaggttgttggtgctggtacatgttctggtactgatgctgttgcaattgagaagtagagttgatgttaccgttatttgattgcagtgacaacaattggttcgaatcatggccagctgagttgagacttgagttcgaactcgtgttgaatccaccactaccaccaatggagctgttatgcgtaaatgcagatgcctgcgactgcgggagctgctgagagtgttgactagaagcaccattattagtgtaatacacagggtgcatcatcacaggtgtagtactacgttgcatcatctgatgctgtggttgctgctgttgctgttgctgctgctgctgcacctgctgctgctgctgctgctgctgctgatattgtgacatctgaaacaactgctgtttttgcaacaactcctgttcgtgcttcaccataacgtttccaaaccccagccctgaattcggacctatatcagcatccgtattagtatttatattcatgactctatcaatttcaccaaattaaatataatgattatcccaatgatgaaccgttattttaaagggaaccccacaatcgatcgatctaaaagagaaaataaagttctcaacgaccagagatcctctaaccaagagatttcaatgaaaacgaagcgcggctatgtagagttaaaacctttgattcaagaactgttcaagttcgaccagtcttcgtgattctaacttttctttaaatctaactttaaatcttactttaaaagtacggcctcaggactgcaagtgattgatgcactttttttccgtttaaagtctcgaggacatttgcttaagtaatttcgttctgagatttggaaaggctcaagcacaatgaaacaaaattttctacacctaaacacctgcacacctcgtacctgcgtgatctgaacaaactctaacttcactctagcttctctttgaaatgagagcgaataaatattcactgaaattcactctccttgcgctgtcaattatgagagggctatatattaaatggctgcatccacatattgcacaagacaagcttcctcgtttctctagtctacctcatatactttctttttttctttttccggttttaatttgggtttttaagtggatcatgctcgaagctcgaagatgcacacggctgaaccgtgttgaaagagagagacaagggaaaaaccagtgtagtttccgtagtaccaaggctaagccaaaccggtggggtactctaaggaatggagggagaaatgggaaaaaaagaaaaacaggggctgaattaggcaaaataatccactaggaagaatggtagttatgtatgtatttatctgtgtcatcgagaggtattttttcaattttaacttcttttttttgtttttccttttgttcctctcagtgtctgtgagggaaaaactgggagcgatgtagtagcttttgaaatacgtaatcttcaagatcccattagtttttgattatcttatccaagacagggacacaggtatgtttcatttggtgcctgcggcactaatttttcttggtttacttgtatttcagtcttttgactattaatgcttctgctatcctgctgggcctaaaatttgcctgcccttgctgtttgacgaacggaaaccaagagcgaaaaaatcagactactgacagggttcagttatggcaattttttctattaattctagctttgaaaaacgggccggtatcatagtaagttattttacagacctaggcttttcgctgacgtggtatttattctcatttcttagaaagattcgcacggggttaatgattgggatggagctaggtgatactccttactctattcattctcggtggaaactgaagagtgatcgatacacgaacaactcacgatgatgggtttacgggtcttccgatcatatctcctcgtatgtgtttgtgatcagattcttttagtttgcttggcgtccttgaatcattcatattcggagcgcggagagggcgaagtttcaaataactggtgtgattaacgattcggatagataggcaagaactaagatgagcacaatggttgcaaactagctgcaagggctgcttccttgctcttcatatgtgaacgaaactaaaacaaaccttgacacgttttttcctttttctacgcccgtttctacgccaagtttatcttaattcgtagtctgcactgaaaaaggaaaaaaaagaaggtctttaatacctcagggcaaatttaggctacgaactacgaatcagcagaatgcgactgaaaagggtgtttgctatatgaatcaaatcgcctaccttagcgtcggtctttcatgagaataatccttgagggtaactaggtaaattgtttaggtgcaaatctgtatgtcattcttgcttttcatatcttgttcaaagtgtgacagtgcaccctatgtgctgaccaccactgggagctgtaaataaaccattaaggttgataaagcaccactgttgaacgtctttttaacaaccgaagctatgataacttcccattgatgtaattagacagttacatcagaagaatgtaccttcaaaagcttaaatcgttcatgcacaatagaagagaaagggaacacaaaaaaaaaaaaaaaatagaaaaaaaaaaaaagataagaccctgcatacattttaagggttccagtttctctagggcacatgctacaaatttcttatacaatagcccgttaggaacatcctcgtggaatgtaagccatttcaaaagaatagagtacttttatttattgcgttaaaccctctttccgtgtggttatgtacatatctgtgctctgcatggaaaaacatctgcaaaccattgcagtgtaggctgtaaggtcctcagattaagaggcgccgataaccctgctcattccaatgagatgctcagagaactcgacggtaagttggaaccctaatcttttgtaccatcgacaggccacatcattggcagtgaatacgcatagttcaattgacggacaggtcaggtcacgtgcaagtgggataagtaatccattgaaaataagagaccctaagccacgtgactggtattctcccatcagatggatttcgtataggaacaaacacggccgattcaatttggagtggtccaattctggattcaatgggtcggataatgccactgatgtaaaacctactatcttagtggtatctctcttgaacaaaacaatgtagactaaatctttatccagcatttcatcccatttgaacctaatccatttctcgtttccctttcctttatcgtcatcagtataattgtatatcgatgagccatgcagctcgtagaacgtgctcaaattctgttttataatggcaaggcacttcggaagtgtggaaccaagatagtttggatcaccagagtgtactctattactaaatacctcgcacacaacatccgaatcaccagtgctattcaattcttggcagagtacgcctgcgacacgtctcaagtttctactatggtaattggacatgtcttaagtccatcacagctggttattgaaacagaagctctttctattgctattatgcttcaccagcgcgtattaagctccaacttttcaacagtttttgttgacatattccatgccactacatatttgaagctaaccaaccgaaaatagaagggaaaaaaaagaagtaatatatacattcagtgaatcgcaaatataaggtcaagaacactgaacagtgagacatagtcacaatccttggtagtgggacgttgaccaatcaataggagaggctttaaaacatagctgtgttccaatgaatgcgatctcttttttgtcaaatgcacttcctgctccgcaggaagtgccgatcaaagagaaggagggtatattagtggatccgacccccacgaatacccaaccgaacaaagtaaaaaacaagacgacgacggcgtcaacaacaacatcaacaacaacaacgtcaacagctacgaataaaaggaatagaccgtttatgagatggatatggtgcatattaatattcctaccaaactatttgctaataaaacctatcataacgatctggtacgttatcacattcccattgaatttaatggaaaccaacacgcaggggaacaaaggattgatccaggtaggatcagaaactgacagtaggaccgagaaactatcgaaatacgtggtagaagaggatctatcaccgactgatgagatcataataaaccaggataagatgaaaccaagacctattacagaatatttagggaaatttcatttccccaagaaattagtaccccaatcaatgctactttctaccagtcgaaagcttttagtactcgatctcgatgaaacgttgatccattccatgagtaacagtagatcgttagggaacccaacagacaagaaccctagtggcaccacaccaatgatacacctggtagaggtacgattcccgcagacaaacatatccacgttatataacgttgccaagagaccgtattgcgatatgtttctccaacagacgagccaatggtacgacattgccatcttcacagcatccatgaaagagtatgcagacccagtaatcgactggctacaacagacgtgttcggtacagtttcactacagatggtatagagaagattgcacacttcggcctggcgtcggttacgtgaaggacatcggtaccgtggcaacccaaatcgaaacgtcacgtgacctctctcaaatgattatcattgataacagtcctatcagctacgcaatgcatctggacaatgcaatacaagtacatggttggatcaacgatccaagcgactcggaactactacacctattgccactactaaaggccatgcgtcacgtgacggactctcgctgtatacttgcactcaaatcaggtagagcatcgatctccaactaacagtgttattaccctgtccataatatagtactaatttgtagagatgcgaatatgtagacaagcgatttaggaaccgaaagtaatccctgaaccggcatccagaaaagaaaaagaaaagggctatgttcctccaattactccaattattccgaatgcacccgaacacccagacacgccactagtggcatacctcggatcagaccggatacggaatacatacgcgctgcgacactgctctccaattttccactgtaccacgtgacgcttgatagtttttttttttttcttcactcctttcgaccacgcgctactggatcttctgcggcgaccgcattctgttcttcctttctttccctcactttgatgcgattctaacaaggcgccagtctttaacttggcgctgtacaccttcacaaggtgtgtctacttggttaatacgttgaccgaattacggtttgtgttaggatatggatcgttaatagcatataggcgtattgtataagcctgtgtctttgtgttgtatgagtaataaatcctcttctgttctgtactgtgctgctgtttctaactgtcgaggattccattttcgcgaagatagcgattttaaataccttcttgtttctttatttcactaattgttccgttgtaacttgtaacttgctagcgatttttgacttagctgccactctgatatgttgccagtaattcatttgttggagttctaagctgcaacctgtaagctgtaaatatcggcaatcaatattgatatatatatatatatatatatatatatacatatataaggtagactaattttgttgttaaaagtggaaatatatctcttgataggattttttcagactcatcatcactcattaggtttgatttggaagaaagacatccggcgtcaagaaaccacatcccatttgaacaatgattaaacttcccgctaaactgcttggttccagattttattcttctgtaaccaaccagaatcgttattctgtcactaggcacaatgctccaaagaaatgtccagagtccggccattacaataaaattccaattggcaaagaagctgctaggttacaatcccaacctaaagtgactagactgtctgtcgatggaccaattgaatgtcctttggaaggtttccaattgttgaattcaccattgttcaataagggatcggctttcactttggaagaaagaaaggcattcggtctagatgggttgctaccaccacaagtgaacaccttggatgaacaagtggaaagagcttacaagcaactctgttacttgaagaccccattggctaagaacgatttcatgacttcgatgagagtgcagaacaaggttcttttcttcgaattggtcagaagacacattagacaactggtaccgatcatttataccccaactgaaggtgatgccattgctgcatactctcacagatttaggaaacctgaaggtgtcttcttagacattaccgagccagacagtattgattctcggttggctgcttacggtgaggataaggacgttgactatgttgtcgtctctgatggtgaaggtattctaggtatcggtgatcaaggtatcggtgctatcagaatcgctatctcgaaattggcattaatgaccctttgtggtggtgtccacccaggtagagtgatgccagttgcattagatgttggtactaataacaagcaattggctagagacgaattgtacatgggtaacagattcagtcgtattcgtggtaaacaatatgatcaatttttggacaagttcatcaaggctttgaaacatagattcccaaatgcagtgctacatttcgaagatttcggtgtaactactgctagaactttattagaacgttacagaaacgaattaccatgtttcaacgatgatatccagggtactggtgccgttgttatggcctctttcatcgctgctctaaaacataccaatagagaattggtggattcgaggatcttggtttatggtgctggttccgctggtttaggtatcgctgatcaaatagttaatcatatggtcactcacggctgtactccagaggaggcaagagccaagatttatctaatggacagaaagggtttgattctagataccatggaaaatgactctaatccagcccaatttttatacgccaaaccaagtgaaaactgggaaggtgccaacacacagtcattggtggatgttgtatcaaaggtaaaaccaacctgtttgattggttgttcaacccaagcaggtgccttcaacaaggttgtcgtagaagaaatgtacaaacataacccaagacctatcattttcccactttcaaacccaacaagactacatgaagctgtaccagaagatttactgaaatggacaaactacgatgctcttgtcgctactggttctccattcccacctgtagatggataccgtatctcagagaacaacaactgtttctctttcccaggtatcggtctaggtgctgttctatcgcgtgctaaggtcatctcagataagatgatcagtgccgcagtggatcaattagctgatttgtcaccattgaaaccaggtgactctaaaccaggtttgttgccacctcttgaagaaatcaacgacacctccgctagagtcgctaccgctgtcatcctacaagctcttgaagagggttctgcaagaattgaagaagaaaacgttccaggtacagataaaaaggttcaagtcccaagagatttcaacaaatgtcttgaatgggttatcaaacaaatgtggaagccagaatatagaccgttgataaaggtggaacatgatcctgcggtacatacccaccaattctgaaccattctagcgtcctatttcaatcactaattattattcgtttcaataggaaacgtgacttatctcttaaaaggagagtgccgtttccttaacacgatacctagagtagactggattccgtcaaaatagaaatgcgtatctaaaccacattcagttgcactaaagttttacaaaatcgaatacttttttgaactgctcagtttaagcattcctaaactgtatttgtaccttatagaaataaaaaaaacactttgatatctagatactacagtatatacttatgtcaatacttattaaaacccttaggtcccttatcttaatcatgatgcagatagtatctgttgtaaaggccttgctctacattcctcttctcggttaaacatgaataaagtgtgaaaaaaaaaagaataaagatacagatcaattcaacttataaatcaagaagctgcctaagaaataagtggtataacatccgactatttaaagccacagactgctgcacactttgaacaacatcagagatggacaagcctatcgaagagaccatcaaagcgttactcagttttgtcattcgtcaattctatccgaattcatatgtgttggtcttggatgccatcatgttccattctgtgttatcagaagaggatttggcgcacttactaggaatcaagagaccggagttacgttctctcattacagttctactagaagatcgcattctggctcgtcattcacagcaggaatttgctgtgaactcacgtagtgttaaaagatactactattatatcaaatatcctcaggctatcgatgcaattaagtggaaagtgcatcagatcgtcgcaaaactaaaagatgacttggataagaacagtactccgcaaggttatatttgtccattatgttctacgcgtttcactcagttggaagctattgcattgctaaattacgaaagaacgcagtttgtatgttcattatgtgaagaaccgttggttgaagatgattcagggaaacgtagtaaggaaaaacaaggaaggctaaatagattaatggatcaagtgcaaccaatcattgattatttaaaaaaaatcgacgataatatgatcgaagaaaacactttcgagacagcgttggctagattgattccaccacagaacaactccgttgcgcagtacacattgaatccaagagcacgtaaatccagaatgtttgttcccggggatgtcaccatgggtaacgataatagtaggaaagctggtgttaaatcacaggctacattacatgttaatattactactcaatacgatgaattgtatcaacaagatcaacaagagaaacaggcagaagagaaaagaaagcaaaacgctctacctgcatggcatgagaagagtactattggtgaatctgctttgggtaacctaagagatgagtatgacatgtcttccggtatcaagatagaaaatgatgaagaaactgaaggacaacaacaacaacaacaacaacaacaacaacaacaacaacaagataacaataatgaaggtttcgacgagggcgattacgaacaacaagatcaatctcaacaacaagacggatcacaagatcaacaacagcaacaataccaacaacctatcatcaggtccacattaacagacgaacaaatgaaagaaagagaagcggagcgtacgcttgcggaatactatgctcaacttgcgagaaaaaacgcagatgaagacgacgacatggatgacgatgaagatgaggacgatttcgaagatgtccaggatgatgtggacgatgatgcagatgatgcggatgatgtggaaaatgaatcttctgatgaagcagtcaaacaatccgatgaggacaaaatagaatcaacaacctctcctgacgagaaagcatcatctgcgaagacacaagatgatgatgatgatgataatgatgacgatgacgacgatgatatggctgagttagaagacatagaattggaatctgtgaaaggagaagataacacagtaccgggagactccaaatctccaggggcgacggaaaagaagcagactaatggaggagatgatgaagatgatgatggagaaggagaatttgaagatgtttaaaacataaaaaacaaccagttatttcatcaagaaacatagaaccaagagcctcgcgatgtacatgtctacgtagggtatgtatatatagcatcttcgatcatcctcattcacgtgatcactatcttttcttcttttcatttgattaccaaattgaaaactttcagatcagggcttgcatccagcaacctcatcgcatcactaacgagaaccgacttgtaaaaaagtttaacagcttgtcctaatccaggttctgacggcatttattccagtgatgggtaacgataattggagagttattgctagcactgcggctattacttttgccggtgtgaagtttatcgatttggctatcaagtcttggaataaacgcactgcagcatcttactcgggttcagacaatgaaaaagatgtgaaactagccaagcggctaagggagactagagaatacgataatttgctttacagggagcaacttgctcgtaattatgctttcttaggcgaagaaggtatggaaaaattgaaggaacagtattttattgtcgttggtgctggtggtgtcggttcatgggtcgttaccatgttggtgagatctggtgcctgccgtattaaaattatcgattttgaccaagtttctctatcctctttgaatagacacagttgtgctgacttgtacgatgttggtttatcgaaagtgaacgttttaagagatcatttacaaaagatcgccccatggtgtaacatcgaagtctgtaatgagctttggaacaaagaaaatgccgatcgtttgatttttggtgatggaacgcccacttttgtcattgattgtattgataaccttgatactaaggttgatctattggaatatacatacaagaaaaacattccagtcatagcatccatgggagccgcaactaaaagtgatccaactagaattaatgttggagatttgactatgacagaagaagatccactagcacgtactgttagaagaagactaaaacaaagaggtatcaccaagggcattcctgctgtctttagtgcagagaaaccagatccaaaaaaggcaaaattattaccgttgccagaagaagaattccagaagggtaatgtggatcaactaagtgcattaaaggatttccgtgtcagaattctacccgtcttgggaaccatgccaggtgtttttgggttgactattgctacttgggtcttatgtaagattagcggttacccaatggaaccaatagaaggtaagaacagaatcaaattgtacgatggcatttatcaatccttagctggtcaaatgacgcgtattggtcaaaaagaccaaagaattccaattgcactaagtgacattggatacattgtggaggaagtgtggagaggtaaatcaccaatcagtaactattctactaggttaactttatccaaatgggatccaacaaagccagtgagcattcaaaacgtcatactgctaaccaaagatgagcaaagggagcatgaagctagaatcttgaacggtaccgagacattttctgatgtatactctgaagaagctttagcaatgattaataaaaggttccaagaagagttgtactattctcagttcaggtgaacgagattataagaggagaatacacttcgttgaaaatgttggctattggcataggttttcataccatttaagaatttttgtattctaagtttttaaacatcgtcaatatatgtacatatatatatccaacatatgccatcaccctagtgatagatcagaatttataaaagtgtaatagtatcgttagaatttgtcgtagtgtaaaagccatgacgcacccgacatagagtaaagataatgagaaaagtagagtaagaagaacatatgcatagaagaaaaaagataataatcatgaagttatgtcgagggaaggaaagcagtgttttgttttgcatggtttagaagccttttcgaaaatgcagagcaacggaagagcttgtaatagataaataagagcaggaaattcagatatgacataatgagacgttataaatagaatagaagggaattgagaacagggataaatatggacaggcacacaacgtgtgtttattttaaattcccatataccacttcattctttcatatacgaagaacgaacatgcgaccattggtgtgaccttgatgtaaccgatactcaaaccaacgaaaaaacctctccatccacgttcgtggaagataattttcgccatctcagacatggatgtaaatttatgctcaagcggattggtcacagcaccgacttgtagacgtctcctaataatttcaaatgggtatgccgctgtttgggaagccataccggccaatccaccagctaatagttctgcccaagtattcaatggaattcttttccccgttcgagtagtctgtacatccactttcaaatcatctgcatccaagtcatcgacacgaagtaccgagtatggggcaatgactggatgtctaagtatgtcatggaacaagtcatgtgcgaagaatgacacacctgcgtaagggatcatcccaataacggtagggatataaccacggtagaagttacaccattgagcgaaccactttggaacgtaagctttcgaagacaaggcttcagaagctggttccgagtaaatctgctttaccaacggccatacccttaccttatgatgttctgtcacatatgccaatctaactcttatcaagtccaacggataagtacaaaacacagaacataaaccggccaacgaaccggaacaaagccttctgaaatgagtctcatactctttgctcggtataatcacgtttctgatctgttcatatgctataaatttcactgcagcataggggaaaatcctcagcaaagtagccgaatgtccctggaaaacccctctcaatctatctcttgaccaaatatgcacaccagcgttcagtaacccctggaacgaacctgcgtatttcacataatgcggattagaagtctggaaaaggatcttgatacgatctaaaggggctatcaaggtttttgcacacgaacctgctacccctccggcaaggcccgattttaatatataatcaaaattctgtttgctggtgtatgctgctgcatcaccagattttcgcggaagcagacctgaattcttcgtgttactattcatactgcaagctgtaacagtaccgccggtaccatcatttgtcgccttctttgcagcgacatttgtcgacattccttataggacccagtttcgaattaatggaaaacggctataatatatggcacagacgaaataaaaatcaagtactataacttgatcacgaagcaaaaataatgccgatatatttttgtgtatgccggaactagcgttaaacgaatgtaagaccagataaaaacactattccaagcgatcattccaaacctttgagtatcaaatcttctatttttttaatccttttcttcttttaaaggttttggcttgaaaagcccgaaagtctaacttgaaaacctgacatatgaacagtcttgattcagaaaaaaaaaaggaaaataatcgggatttcacggttccggtgaagaatccttgaagacattgttttatttgtatctctgtgaaggagtcagaaggcagagagaggatatgtacaacataattggctcttttccagtgcaattgtctttatatttatagtgcggtcgcagttttattatgagcttaggatgaatgggaccggtccttacctgccaggcgacagaaaaatctaacagcaagttggtcacgtgctatattccgggtaagaaaatcatatgctgctttccgggtgtatgggtgaagaggccaggaaaacaaataaccgctgaagctattattaacatctattacctccaaacaagatgatctcgaggtcgtaatcgtttcaataagcttctatcgataataatataggttaagttctcacagcaaggtaatataacacctagtgggtgtttgcattcattaaaacctatgtggaaaattgaaaagcagcccgcacatctacaaagcagtattggaacatggaaaagtgattcgaaatatcaaacaaagaaaccattaacaactggtattctccactggcaagtctgttgataattccaaacattcacgtgacttgtgtacttctccttccctttttttttttgcagattttccgctggaatttcaacggtccaaatgataggtgaaagacatctgatgccaatatctgcgatgagaaagggaccagattcctgtgctactgactcttttttttttgagctgtgccagttgattgcccatcggacagcttcatataaagagagtcttttcaactgtttcaagcgtttatctagcttccagctctgtcttgtattgttctattcagtacttttctttagtgcccaaatatacgagctcacgcagtgtgaatcgacgatgtcaagtaataagccggctgtagatccattccattccttcctagcaggatcaatcgcaggtgctatagaagcctccatcacttatcctttcgagtttgccaaaacgaggttacagttggtggataaggctagtaaagcttccagaaatccattggttctaatatacaatacgggtaagaactacggtatttcatccatttacgtcggttgtccagctttcatcgttggtaacacagcaaaggccggtattagatttcttgggttcgacacaatcaagaacttgcttcgagacaagaagaccggtgagttgagtggatttagaggtgttgttgccgggttaggtgcaggtttgttggaatcggtcgtggctgtgactccattcgaagccatcaagactgcattgatcgatgataagcaagctgctgtgccaaaatatcaaaataacgggaaaggtatggtgagcaattatgctaagcttttatccgatcaaggattttctggtctttatagaggtgtcttaccagtttccatgagacaagctgcaaatcaagccgttagattgggttgttataacaagatcaagactttggtgcaagattacacaaacgtacctaaggataaacctttgagttcaggtttgaccttcattgtaggtgccttcagtggtatcgttaccgtttatacgacaatgcctatcgataccgttaagacaagaatgcaatctttgaatgcaggccaatattcttctactattaactgtttcgctaccattttcaaggaggaaggtttgaagactttctggaaaggtgctactccaagattgggtagattgatcctttctggtggtattgtcttcaccatctatgagaaggtattgacggttttggcataattagcctttcagctttcttagtgtgtaacaaacgtgtagtttacttataaaacaaaaaatactaaacgataatcttaatccgcatcataaagatgatcggccatttgatgagaatcttttccatctatattgttatgatatacaaaaaaatataatacacatgtttgcatatatccacatgagagacatcaaacatgccgaatagcatcaggtaaaaggaaccattgtatcatgaaatagattaaaagagtaatttggtcatagggtgcactgaattaagagaagacaaaaatttcctttttgttagtttctgaagaggaacaatcatagagacagcctgtttgttttattatagtgtatttttttttaattttggatccacaacaacttaatggataggattacagtttgatttattctgatgggatgaaccatttatttatgagtgtagtagtgttaaactcgagagttttgaccctgcaaagggtgtctttaagctgcaaaatagaatagtgaataaaaatgtgaatagggcaaaaaacgaattgaatatatgagaaaaggttgaaagcagttagtctgctaatgctaatatcatggaagtcaaaaagaggattttaaacttctgctgttgctgttgcatcttgcaagaagcgtgcctccatgcgtttgaccttaatgtaatcccagatactcttgattattatgaacccacctaacagtataacgaatatggccaatgccggtgtgtgccgcgtcttttccattactccatgagaaaggtccgattcgaattcatcctgagtagaagtacttgtatatagacgaatctcttcaaacgaatctggattatcaaatgtaaacctgttcaattcattatcctttcctatctttcctgaaacatcgttcggtatcatggaatatccgtatccaatgaaagttaccccaagtccaaacctggacccttgcctagctgcatgtgatgtatgtaagatataggtcaacaagaacccgacaaattggaaactgaagctgaccacaacgttccataagaaattgaatatattcccaactggaaggccgtcgatgcaaatttcgttgtaatacaatccaacgccatcgtcgtctataccgtaatatggtggagccatatcagccgcagcctcgtcatacgtaggaggcttatcctgttccccattcccattgataccgttcctttcaggtttcgccataagattactgaatacaccatcagaactcgccccgacttgtaacctcatcgcttgctcgcttgaactgccgcctctaaacagtctatctaatatattgaactttcgggcaacaaagttcaaatgttgttggaactgcccattcatctggtgcagtctagaagacgacgaagttgtccctgtttccacatcatcagctcttgaagattcggtttctggctgtgtttgcagctgcgactgcgattgtgaaggagacaaagtcactgaggaagatccaccgacttcatcttggctcctgccaacgccacttccggctacgaattccgaatgctcagacatactcgccgcgtagataatctcagtaaactctactaccctcgagtaacactcaaatatggctgctttgatgagtttgtggcctctgcataccaagtttcttaaaagggttggttcgttcaaatgttaacgtttccattactaaatatattttttggttttgagctgtttatgaaatttagaggcttacaccataaagaatgaaacaggcacacataaatatcgatatacgtagaggtgcgtgtcaagaccctcgagtaagcccgcgatcatcggcgttcggtctctcatagctatcttcagtgctctttcttctagcttatttatcatagtatttcttaaaattgttacaggtggtaccacataaatacatatgtacatatatatatatatagcgaattactcattgaatggttgtcttcgcctttggtagctttatagtgacgagtaaagatttcccaacgtcgtgcataataactctgcatgctgatgagtttcttacttcctgttggaattcttgttttggagttgctttagctctgtctaaatattcgactctagttgatggctggaacgataacgtacttggaccaacatcaatacctccaggcaaagttgttgttggaagtagttgacggcacgtttttgggatatccccaagatcaggaagttctgcatcatggggtagttgcggtgtacttccggacgatgggtgattttctgtattgcctcttctattgaaacgaacttgtctacgtttccttctagtgtctctgtccttatccttaaccaaacgttctagttctgcgggagatatctgtaataagttaggtgtgtataaaaacgtatccttttgtggtctcattacgtctgctaaggtgagtacaggcaagaatcttgttctgatatcgtcttcttcaacggggctaccgtcaaatttgtaaccaaccatatataatgacttgtgatacatgtgaacttgttctctaatgcaatgtgcaattgctgttaagaattcacccggaagggatagttcttcgcataaacactccgcgaacgattctggacaattatctggatttgacacatcccattcaacggtatctatcaattgatgttgtccaacgacaatatctaggttgatttttattctgaaatcatcgcccccgaacctctgcacattttcaaaaggatttggagtatattcttgaagttgttctttgatactattcacaatctgttgatacatctccgtggtgactttgagcctataatccttcagcgttgttttcacaaattcgttgattgacagtagcgtgtctgatctgttccatacgaatgtgtccctcaaagtaaatttatccttttctgcatcaaactctaatctaacaggtactagttcctcccctgtttgattcattgtccattcatatatttcgtccaagtgcatttcataagtgtcatcgacttgaatccttgtgagatcgttactgaagccatttccatatccagaataaccgtcaccccatatactcttagatttatgtccttgagttgtgttggtaatggattgcattcgactgttcctcaattctttgtaataatcaagatcttgctgtaatctcaatattacctccctctgactgaatccgaatttggaaataggttccaatccattagtgtccgccaacaagttgtccttatccaacaaatcccgttcaataacatgttcatataatcttgtatcaaaactcacaggctcgttatcagctctttctttctctgaccataacctagtatgaggtaatggagtctcaggtgggtcttgaagaatagtttggaatttgggaatatcaggaagttgtttctgaaacttctgaagcacttgctgtagtattgcagcttgtgatggttgaggtggctgtggtactgaaactgggacttgttgttgttgttgtcgttgtggtggttgtcgttgtggtggttgtggtggttgtgattgtggctgttgtgacgaaggaaccatcgattgattactgttcataactggtatattctgagttataggttgacctccaatcatttgttgtggattccccatttgttgctgaagtggtatacgaggtttctgaggttgaggctgttgaagctgcggttggttaggaggaataatgttgcgtggcggggattgatgttgttgctgctgaacaggttgttgtggtggtacaggctgttgttgctgttgctgttgctgtctatgttgttgctgtaatttgacttcaagctgagtgatcatcagaagagcgttctggttatttctcgcaatagcctgttgtttgatggactgaagccattgcatttgcaatgccggtgatagttgtgcaatttgtggaggaagattcaaagaagttcgttgttgagattggggaggagactgctgctgttgctgttgaacctgctgttgttgcaattgctgggcttgttgcacctgctgagctcgttgctcctgttgctgctgcgtctgagatctctgcatttgttgttgtttgagcttcattagctgcgcacgctgagcagcatccaattggttcatattaccgggagaagaaacctgttcttgctgcatctgctgtgcttgtctttgtctctgcaataacaactgttgatgtttctgctgaatcatctgcaactgcgctggcgtcaaggattgtaggatatgttgtggaacctgcgaaagcgaaaaggaaggcgtccctatgttactcaaagggttcgcattgccaggattcattggtgggtttgacattctcctttcagcttatatagagaaacaaaactgcaactagtgttttcaattgcagacagaaagggaaacacagaaggaaactagtatattctttcttgcgataattctcaaccaaatgctgtcaaatataccctttctgaagcctacctgaaaggtgttcagttcccttaaaaacaagaatttcttgttgatctttaaagtttgttgttggtcttgttctttcgttctttgaattcatgaaattcacgaaattttgattaacgattaagagaagtacgagatggaacaacctaatgaaaaattaaggcaagcaaacaggatacagcgggttatccgcatatagttggttatcatagtgaacttaagcaattggctacaatgattgttagcatatatgtcaatgataggtgccaggaaacgctattccagtactcaacagtagcagagtgccctacttttcggcaactagttgttaaactacaaggtaaagacgaatcatgggagtctaaatactgcaatgagataaattctgagttgaagctttgcagacacgtttctttgctgaatccagttgtttattggtgtttaatttcgtgttcagagtccacagtttccgtggtatctttgttagaagagatagatttactgttgttacaatatttcgataaggaccaattaacgaagcagaagataaataataacctcgatcgattatcgatgcttttccattgtatccttgatgctgggcaaccggtgataacagactcgaaccgtttaaaggcaatggtcccaagtagaaacgatttatcgaaattgttgaagacgacaaccaatacaattaccaagaccttacaacaaccggacgggtcaatgtttaagaatggtccggaaaaatcaaggtttagtggcagtagatatccatcttcatccgcttcatccgtttcctcgttccacgttgggtctcctggctcctcgttagttgatcattccgttgatgaatctggtgtcccatggagaatgagcggcatcaactatgctaataacgaaatattcatcgatatgagtgaggaaattaacgctattgtggaaaaggggaaactgttaaccggacatatcaagggttgtatcgacttaaacaaccatctcagcggacagccattggttgagatgaaacttgggctcttagaccacaagcttagccacttaaacacgactttccatagatgcatcttagaggataaggcgaacagcataaatgatttaatcgctgggaaattcactaagctaacgtttgtacctcctgatggacgtactaggctctgtcaatataccctaccgttggtgaaaagagactcaaacctcggcattatagacgtaaatttacaaagcagtttaggtaaaagacttgacgaatttgaggtccgcgtcaccgttggaatgagcacgacggtgaaagaaatagaaaacatgagcatgactatcaggatgaatagaaattttaagggaatagtacgtgtcatgagaaacactcacggcggtgtcgaaacaaatatgactcgtggcgaagttaattggcatttggacaaaaacatggtatgcggttcaatggctgtactacgttgtatagcggaactggaacccgaactcgcctccaatgaccaaacatctagtagatcttcggttgttcaaccacctagttcacacttaacatccttactacaacctagtttcatcaaatgttactacgaacacaaatcccagcttccctccggaatcaaacttcaatcaatcgacgtagttaatggaggtccaaaaaaaccgttcaaaggtgttaagtacctcacaaagactggttcgctagagtataggtgatgatacgttaaatggtttatatatatgtatgtatgtatttatgtatgtgtttggatcacgtgatatttttgttttatgtacttttcgaacgaggaaaaagtgttccaactgattaaagacttaaaaggaataagtagagccaccttggataacagatgttttaaagtttctatgtatgcaatgcggagggcaagagtgaattccagaagtttcagggctgttctatagtgccatttttactgatctcgacatagagcggttaatttgggcgatttgcagctgatatttgacgaataatcgagaagaggggatcttgaatcatagcaatgaagcgagaaacgagggaccgtggaaggacggaccttgcaccagagaagtatgtagaggactctgatccagagcctgaggatgaaggtgagactcggtgtatttgtgggaaaattgaaccgccagatgattcgggtctttatattcaatgtgaacaatgccatgtttggcaacatggatattgtgtgggcatatctgaggaggaaactccggataagtattggtgcgagcagtgtaaaccagagctacactcgctctacacaacggatcttggtgagaagaggtcaatatacaagccaattcagcaacgccgtaggaaaaatagaaggtcgaaaagaaactccgaatcggatggagaagtatcaaacgctggaagttcactagagaaccaatctccttctagctcagtggttagtggaaatattggatctcaaagattatctcggcaaaggagaaatagtagtaatgttgaattatcgaaggatgaaggtgaagattctattgcggactccggaaatggtgaagataaggatgaaaatattcccaagcgcgagtttgatccaattgatgaaaatcaaaaggttgcagatcgtaaacgtgctacatccagtgccagggaagagaaacattatcaacttatgctagagaaagccctacgcgaaagcagacgctcttcaaaagatggcaccgatcccgaagaccaagatattttgaaggaagaagaggcatcagggaagtccgcctcaccaaagaattacactagagatacggaatctccagaagtggaaggatctgaagctgatgaagcagctagtcaatcaagaaaacgagctagaacgacaacaaaatctacatcgccatcaggttccgaagatgactccaaatcaaaaagatcaagaagaggtaagagcaatggttcaaccacgcaaagtaactcaaggatttacaagacctcaagtggaagagttgcaaggaattctaaagctagcagctcaaaaggatcgggttcctctggaagttcaaacttgtcgaaatctaatggacaatctaatgatatcggaatcaacaagcctctaaaacccaggattccctctcagaggaccactatgcatgaaatgagaagaagagttaacgctattctggaatttatctcaaggacacagttagaaatatctaatgaccaacgtcaacgggatcagttgtgccagtttgtggaaaacgaagaattcctggaaaatattaataaaatattctccagttacgacgaatccttcaaaacgatggatgagctaacgaggaaattactgctttgggagcaaaagtttagtccagcttcttaaaagcatgatagagagtgttcttttcttgtttcatacatttccttacctaattctacatctgaagtacatacgtaagttcataataagtcaactggtttatcattaacggcgcaaacatctgttaaaaattgctctgtagaaataatcgaggttcctccaatgataactctgcaattgtccttatttttactctgtttctcattgaattgatgtactgcgcgcgcttcttctatagtgaggcctccgacgatcaatataacaacatcttgtggcatatatgtcttagggtcaatattttggtttaaaagagtcactccctcttgtgggaacttgtttttatccaaatcgctgagaagtgttgtcaattcaggaacatgttgcataaacacattttcagcgctggtgctgcctaatctgttgaatttcttggttaatccactaatcaaatcattgtcctgaggagctttgtgtttattgaatattgacccaaatctctgtttaaattgaaagtaaagagaaatttgtgtgggatcacactgttgtcttagaatattctccaactcagaaactctagattcgttcttgccgtgtcgtagaacaaaaatgcagcataattttaatttgtaatatgattctaaggttggtaagtttagaattctcttcagttctacaaagtcatcgttattgtcatcatgtgaagagaggttttgctctagctcactgacttcccatatattcttcagttgtaattgcctatctaattcactaacaatggccatatgttttgaaatgttgcctgagagtttcttaaattcggggaacttttcgatgaactctttaatatcttctatcgtattgatttgtttggtaatgttggtcttatttttatactgagtaacatagttcttcaccttatctgccaaatcaccaaaattcatatacattgtttctttgaagaacttatcttgttttgaagagagtacaacctgcttcaaatcgggatcgatatttggtacattcgaaaggtctaccaagtttctttttattccgatatattcatttatcatcgattgataggtccacggttgaagtaatggtgtcaatggatccgatttcctgtcaagtaaaattagtaacggattcgaatctctgacgggaaaatcaaataactgcctttcatttgtcttaatttcatactctaaatccttagctaacttttgacacaatttgctatccgagtcatacgcaattgtcggatttagttttaacgatagtagcaatgagattaacccgttagacgtctcctgcaatccctttggatcccataccaattgattttggagaagattgtacaacgggatctctaaagtgaagacatcctcgttcacaattaggtagtcttggaaaacttcttctacatgtgtgacaacctccatatcatctctttcggctaaccgttccaactgggacttactcacctggttattgaagaaaatctggtattcgccatacttgggatcctgtaattcgtgtaataggtcttgaatcgtatcctcagtgggtttcaaatagcataaacatttcaaatgtggcattggatctctgtgaatattctcaagtttatcgaccaagtaaatctcgtgctttaatagctcggtttgagtagtacacatcgatatcgtagagagtgtgtcattatccaaaatcaatgcctttactctcgacttctcctgtatcgaggtgtccgacggtttggactggaaatttgcgattctgctgatataataatcaccaaccgtaaacaaattcattacgaaaaagtgctctatcctctcaatttcaaaagaacttggatatcttaattgctgattcaccgttggcacgcgctacagcagccttaatctaccgtttctcactgctactttgttccatgcaaaagtttaaggtcatttctcctttaatacttattttcaaaaagagttgaaactaagattctggcacacatcaatccatctttgtttaactacaaacaaacacaggaacaacaatcttgctatagcctgtgattccaaactttacatttaggtgggaaatagcaatttttccacaattctgtacagtcaaggtaataattcttaagttgaggctactggctattctttacaacaatggccacaatttcccgtgtgaagcctgtgaagactaattcagataccagtctatcacagtatatgaagcagaagaaaggacatggaaaacctaaacagttctctgcaaaatctaggagcaagagcaacaccagtttcaagaacttacagaaattacacaaggtaggaagccacgatgcattgaatagaggacttttcgatcctatgaagaaatcgaagagttcggactcattgaacagacgcacggtacacagtggtctcagtatgacggcattggtaagaacatcatctcatccagttgtgctacaccagaatagtcacagcatgaagcataagggcctaattagtgataggaactccaagtccgtcatcctagatcttcacgattctggggataacgattctatgactgatgaagaggtagagtctttcaccgatatagaaggagatgatgcatcagatgatgagacaataaatggaacgggcaaaaattcaacaactcagaggaactcgatgcatagcatcaatgattttcaggacagagctgggttaagagtggattctggtagacctctacaaaggccattgagctataaaccaccgtcacggcttagaaacagagttgatgcagatgatgatcatatttcatcaagagctgtgagcccaatggataatgacaaaattgacgctcctgacagggaagatgaccttattgaccctggcaatcaggacactatatcgaacacgaatagtctaagacgccacaggcaacatatgtttgatttcaataatggaaacggtaatctgcagaaatcttataatgtggaaactacggagcatgaggatattatagcagcgaacactgccgtcgatgaaggagtgcgtcgttatactgaagaagatattattgacggaattacacatacagcaacaaacgaaaaagcaaatgaggatattggtagtgatgatcctaagcgatattcattcgcaaaagctggcgctgtaactgatgaacagtttcctgaggatccccatagtaatgacagttcctcctccagtaagaatggcaatatgattcctgatagcaacaacactgctctgaatggttctaatatcgactctgaaacacaaggaacggaacaatacgttcctgatatgattctatctcagtctaccggaatggaaagaagatttgatcaattatctcgtcagagttcgttagcatggctcgacccagccgaaaataataacgataaatctctcaagatacagaatacaaaatccaataaatttaactatatcaatcaagatttggcagcttcgttgaaaaatgacaatattgatcagccatctcctccgcgccatcaagaacagcagccgaaacaatcgaaggccgacttttctacagctatatccagtttaaccagtcatttgacaaggcccgtttcacgcgaccatcttttacgtgcgaacactgtatctcagtcacgtccacggcagcaatcactctatcggcaaccatcgtacagtgagaatgataccagcggtaatggcatgacagatttctcgtcatttttgcaatacggagacgtcggaactgactcaagaacacaacaaaagttatggttgcaaagagaaaattcaatacaagatctaagcagtcaaaacacctctcctgatgcagtgttcttggcctcgaatgtggaggtgagaagagaatttgaaagaatttctagagaatacactaatgttagaagattctctaatccgttggcagattctttgagcagaatatcgcaacaacaaagtattgaaatacaaaaacaaaagaaaattagcacgggtgagaacgcaggaagcttcttcggagtcgattacgacaagggtaaatcatccaaggaaactaactcaactgccaataagttggaaatgcaacgtatgctcaccaaactttggaacagcaatacattagaatttaataaggacgaaaatcctctagttcaatcaaatcctgaactcatgacagtgcagcaccccggtacctatcgaaacacccgtccatcccggatgtccagttctcaacatcaaagagcagtaaactcgttgcatcccactactagggcagtaaatagaagaatggagcatgttttgaaccaacagcatgtgtaaacagaagtatatatgcattcacaagcatttcggatatgcactcgacatattgtagtattttcatcattctctaagaagtttcactttaagatataaactttaaatgtaactttcagaataaaaaacaataatcttaatgaattattgaagctatttatcaaaatataaatcgaacatgaggtattaggttgtcaaatagtatcttgtcattttccagatagcatatattccgcacatttataaacgtattatttagaagattttatatcactacgtcaaatcgtgtcaggaactttgaagccgaactttcttccttcatcataaatgttctctagatacatttcaaatacacccttctcctttagctccaaatactttctataaagtaacaacgcagtatgtgcgtcttcgatggagtcatgatttcctgtttgcacctgttttctcaaaaccgcgaacgccaaataacgtagagaaagatatcttttcccttttaaataatacaacgacgtgtctctaatttgagattctgggacatatatattgatctgtctgaaatcattggttaatccatgtcctacaaaaacacatcccaattgaagtagtaaccacatttttctgtaaaagacttgtcttttaaccaaactttttttactcagttttggatccaagtctcctggctcgataccactgaattgggttagataatcctcgatatgacactcatttataatatagtcatcaatgaatggaacaccttccaactcaccttcacctctcaacaaagatacacgagccaaagacttcttagctggtttaagcaaggttttcatacctttacaattgatttccaagtacggttctgtcaaagacacgaattccgcgtccaaggcaactaaggtgcccggtcctggtgcttcatctttagtcaatagtctgtattgtcttatcacgtcttttctaatgccctcactgaaatagtcacgatataggatgtctgtgtcaacctttaatttcgaaactgaaacaaatggctttctgatttcttccgcatcagaataaacaacaatttctggtgttttccaccagtacgaaatatttaaagcctcatcctcatcaatttcttgtaccaaaaagtcattaaacatgtaccacttgtactgttgtattttctgatccaagatcttagcgtacgtgaccaaatgctcctcaccgaaatcgtctgtgattcttgcgacataggacattaattcgtacttgaagatagcattagacgtcttgaggtcagtggcctgaagtttcaagatgggtctatccttagagattgtggcaaaaaagtggtttgacaaccatccattaacagttttagcagttgtccattcttctggtgacaaacaaatattgagtgaaagtaaaggtggtaaatttctgactatgctttcgtattcttgattttgcaacttctcgcatttagaacatcttgctgtcaattgcttgaacctgcacatggatgattcaatatacggtagaatggtttggttactcagtttcttattgctatattttacgttgttgcttgccggacttaaaactaccaaagacgacacgagatgtggctggcgaacgaaatttccgcaggtagataatgtgtgaatttcagtatccacattaagcccaaataattcttctaacacaatcgcgtcagttgaatgcaactttctttcaacttcttctgatattaatctatcaagtaagaaaatattaaacttttgagccacagtcatatatttcccataggaccttttcattatttcttctgcgtcagcatctactgacaaattcaagttatagatgtgagaggataagttcccttcatctaaagagggcttgccagcatgccctgatacagttgaaatttcgtcagtaaataaacccagctcattagccgttgatattgattcaagaacatcaacaaagttagatgctcggcaaattttaccattcgctcttgtcatcatatcaaacaaaaacccaagctcggtcaaaacagacttttcttgaatgtgttcatcttccaaacagttcactacaaagttgtaaacttcaggaacgaaacggtacaaatggattatttcattgatataaacacagtcaatatctgtttccaatcccgaatactgagttgtattgaatccaccaaaatcgaaatccattactccaaacttcccatatatcatttgtaatttgctgtatgctggtgggatatcaatgttattggaaggtttatattctagtagttctttcctatgttgattatcttctgtcgtacttaccattttttttcttctttcccttagcgacttataaggctctataacatttcgagggccatatttgaatttgttgtacggctgtaatgaatacttactgcttgacaagtgagaaagagacctgttaacactcttcgtagaattattgtcggtttctgaagaactgcttccttcaatctttttagatatgattccttcagttttgaatacagtgtgaggccatgccgacaacaatgtttctgagtaatagggtagcccaattgaacttaaagggtacgattcctgacccacttcgactctatatgggatgaaactgtcttcggggtaatcctggtattcaagtactgcagcagagttggtaaatccagacatagagtttgatctgttccacatatttatcatgctttcttcttcaagaaaggcaagataatcaccactgggagaaagcgtgaattggctaatagatttgcaaggatggatgtatggggttcgtaggcttggattgaccaaatctatgaaatcgaaacttcccgaagaagacgcaacagccacgaccgttggcaacactggatgcaattgtaaaaagtccgcacctatcggaaatttggacgatgtgtgattgcccacaaaattaggcgttttggaaaaagagatgggcggtaattgcttcattattctcacatcgtaaacgtttatgaattgatcagactgcaagtagccaaacgtttttgattttcccgcagttaccaaagtattatctttgaaatccatcgaggtaattgatgcagagtgtcccgataaagaatgtatcaccctattactgactggatcaaataaatctatagatcccgcttgcttaccaattgccacaagcttgttatttgaggacatgtgctttacctttgaagtaaagtatgtgcttgatgctagtgttccttttatcagatccacagatattataccactggctgtattaccaccagcacatagtacttgattttggttattggtatagtaacacatggtcttcatatcggaaagttgtgcgatatccgctgaagttaagctcatctgagtgacaccccttctattagagaaatgtaaagaatcggagcttagtgatagaataccatttttattgcttaaaaggtcaacaacaggcattgagcctatatgtgccgtatgtctggtataaagtgaatatgtcggatcatatgatgatacgcgtccgtaggaatctccggcccatattagattagcctcagtatcaaatactacctttgttacttgcttttcctttttatcatactgcaaatagggcttctttaaatgatacgtcagatcttctggtgactgataggaaagttgccaattgttcatcactggttactatagttcagttatttagtaatcccctttcatacattcaaaagagcaacggtaagtatctcgtaccctaacaaatcacagatgcacggtaactatagttcgcttttaccagctgaattccaatcgaataacctgaaagacctgtacaggtaccgctaggtttaaaaattatacagtaaagtgtcttttactctggttagttcgggatatacctcgtccctggctgctttgttcttcacttcactctatgtttatgtttgttttgacctttttacatggttttcttaaaatttttcaatgttatcgctcaatggacctggtaaaatagaatgacattaacgatgagatgaccttttaatgatcgagaaaagtggaacagtggaattagggaacactacaaggaccttcagggttgataccgaaataaataaggattcaaagggtagttgcatgtaatgctacaaaaactgaatcatgttggtccctctctggccgtaaaattctatgagaagtggtgcttatgttcacaaggtccattcatcgaggtattcgattattcgaatggatctagcattaaccgctgtcatattttccatagaaacaaagttcatggtattagcatagataagacatctggaaatgtgttggtttacggttcaagatccttttcaatcgtcaatataaatgatctcttttcgaaaagtgaagtgcttgaccaggagaaaatgactggtgaatggatcatgagcggtgagtttagcttcaataaagaagaaatatatcttttaaccagttacaacagagttctgatcatcgatccagataacttcactgttaaaagtactcattttgtggaaggtgaacggtcgattttatattctggttccataaaggttcttcgccataaggttctcgtaaatgctggaacaatcatgaatggtattatagtatgggaactagactcaaagaagaaaatacacactctgcgtggtcatgaaggttctatcttttatgtgactactagtaataatgggaaacttctagccagttgttctgatgaccgttccataattatttgggatatggtttctggaaagcttttatcaagggcttggggccatacagcgaggatatggaatttaaagttcttcaatgatgatacacagctcatcagcgtttcagaggattgtacatgcagagtctggaactacaagaacgatgaattaactataaaagatattttcgagagtcatctaactaagaatgtgtggggggttgatgtggaggaaaccaatctaattgctataagtggaggaaacgatggtcggttaaaagttacggaacttgtcccgcataatagatcatgcaatattgaactttctctggaaagcatctcagaacaatgcgacggtttcattcataaagccaatgaaattgtaaaaggtttccactggtttgattttggtttagttttaatcacatcggaaggtaacatacttgaataccttcaaaatatagaggaatggaagttcttagattatgacgatcgatttttcagtttttctattacccaaggaaacgaaaacaccatcttcttcatgaacaacaaatgcttattgacatcgtttaaatttgataaattcggttctgtgttgcaaaaagtcgactatgaactagaacttcttactaaaacggtaaactgcttatcagtaagacacactgctcatttctaccttataattgaatcgccgaatcctagagacccactgttgatgttaaaattcaaccatggttcctgtgctccaacagaaaggtatacgttttctaaacctgaaaacatgatatcaagttgcgcagaagttcataataatcgcttactggtgggtgcaagattcagcttggcatttatcttcgaccttgcatcagaaacgaaacctccaattgtggttaaaactcaagcagctgatgcaataacttctattaactatttggaaaccacagagaatgatgcattattctcaatgactaacagagatggaacttatttctttgttgctgtagacttcagaagctctgtgtacaaaacaatacacgccaataaaattagccgaggttttttggaaggttcattttatgattcaaatgatgatttcttcgtctacggatttaagtctaacttgttccatatttataacgaatcccaacaatatgaagtattcagccaaccatgtggcggagcacataggcaatggaagctttttggatctcaagagcaacaacaggtgctctgttttgtgaaaaattctaccctcaacattactaagatacccaaaggcaaatacccaggagctttaaaaaatggaactcatggaagggaaataagggatatctcattccgaaaacgctcaaactattgtaaggaaaacctactatttattactggatcagaagacacaacagttaaattgtcttctatcaattcagaaaccggagctattcaaaatttctggactctgaaatctcatgtgtccggcttacaacgatgcaaattcatctgtgacaattttttcattacgtgtagtgcaagggaagagctattcttatgggaattgaatgatcaattctctcatccatatgtgaatttgaaacagaaactaatcccttctatgaacaatccagaccttcggataatggatttcgatgtgctatttttgaatggtgacacttgcgatttcataatggctacagtatacagtgacagttcagtgaaagtatggcactactttaacgagcaaaattctttcaccttgatcatagatggaagatatgaaacctgttgtatctggaacgttgctttcattccgttacagaattgcttgaaacttctgattgcaccaacagatggtcatttaattacatgggacatcactaattccgttccgttcgagataaggaataatgagctttttgacaggggcctcaaattggaaacaaaacaattacaaaactggtccgaaaaaatcctggtacacacagcaggtatcaaatcactcgacgtgaagcttgacaagtcttcggattcattcaaagtatattctgggggtgatgacaatgctgtagccatcactaaatttacgaacaatgacaactacacgatgaaagccgaaatactagatcacgattcgtatgctgcttcatcaacagtaacatcagtgaatctgttagataatgacacaaaattattggctacatcagtggaccaggtcataagaattagggacattacgaatgacaaactgaaaataacggagagcaaatataccacagtagcagataccggttccagtgatatagttacgttaccaaacgtccagaaaacacttatattaataggaggattaggactttcctgttggcgagatgaataatatctaaccatctaaacttcagaattttatatatttaaaaccagtttattagtatagaatggaaattatttatagaaagaaggctgcatttttccacattcaagaaaagaacacatcctccattatgacttatctatatacatgaaagattgggacgaatgggagggcgattgtaattcaaccttgacgttgtttatgcttcttattggacttacagtaaacgtacactctgcccttacgtctaaccatgtaacaatcgttacagaacttcttgatggaagttcttaccttaaaacctctggtcaaaggagggttcataagacccatcattggcatagatagcatattgatacttttcacagctggccttgtcagtcttgtcaacgagttcaacatcgtacttccgaaaagtgtgctcattatgtatgtatttccctctctttatattatatcgggctccagagttatacctgtgaagagttttcagtttttgatatcacccacggtcttgaaacgtactaatggagtccacaatcgtcaataaggcatcacaccgactgaacatgccctctatagctgatgatctaccatgaaaaggccttcgataatttttcaaaatagtttcaatggagattaagatatttacccggactatagcacgtgatggttatgacctgagatcttgaacatcctcatctagtgaacatctttgggcaaatctgaagaccgtttcgaatcactaacaaataaataattgatgaagtacacccatcctttctaagagactcttcaaggcagttgttttatcctttttctcggttctcactgtatgtgcagcagcgctctgaatcgaaaacattgaacttcgaaaacgtaaacaatcgaattttagatcaatatattgacacacaaataccgaatcatcataaacttaaggactaatatttaggttaagtttccatttattatcatatttcaccctgtgttgatagtctcgcttcatatgacagatccaaaacgattgtctttgcttccgagaagtatccttaagcaaaaatttaaggatgatgatacaactaacaccagtcataatttgactatgtcccagatacagtttcctactgagggaattaccaaagaagatatactggacggaaacaatacgacatcccggatcagtgctgcgatttcgaagggaaatcgccgtgtgtcctttgcaccagatgtgactttgcacaagttcgaattcataccacaatcgattcaaaatgtaagggaacctcgaaggaaatccgctttaaaattggaagtggcagtagctgaagcctctatggccgataccaaaaatgataacgacaattctggagaaacaatggaatttactagtccgataggttcaatattccaaaaattggagtctccaagcgaaccgaaaaatgatgggtaccaacctgtgttcgacaaagaggtttcaatggatataacacagttatttgcaaaacatagcgctaaaccagacgataatgtggtaccgcaagaaacctctactgctgcggaagaagaagaagagaatggtaacgaagaccaagttttggaggaaacaatggaccttacagaaccgcagaaacgccgctttaacgaagaagagtctatggaaataactgaccaaatacggatggatgcagaaaaacctacgctagatgcagattcagaatctgctttcaaattacctaagataccagcaattacagaggaaacaatggaatttacaaacgtgcaggctcctctggagatgcgagagtcacagatagtttcttcaactcaactagaaccaactcaactcccgcagtcaaaaagaaggaaattatctaacggtggttatcagtctccggtcaaattgcaggtaccagtgcaagtgcaagagacccctgaacaaaaagagaatatagatgcggagctcacagagatggaacgattatcgccaattccgttggcaacaaattctttaccaaaaccaaaaaatgtcggctctcccatactatccaaaacaagtaaacatgttctatcagacactcaaagtcaatcgggaccaatctccttgcagacattttttgatgctgctaatataaaattcaacgttgatacccaaataaacgaatttcaaatcgatcttaagagtacgaataacatcgaacatgtcccatctaatataatataccaagcgttatattgtaagattccaatattagagattcaagctttcaccgcaaaagaactaacccgaagaattctacaatcaaggaatctcttaaagagtcttcgagagcagattgcatccaacgaaccccccaggttgataaaagagtattttgaggcagatactgatacccgttatgctattaacgaaaagttagaattagtaaccataatggctagattacaatctgaaaaagtctggtttgagtggagatcacaacatttgaaaggaattaaaacagtcctggaagaaaatatagctatcttggtggatgaaaatgcccagatcatgaaatacatgaatgaaataaatgacgtgaaaataagagttagtgacatcaaacaggtgttaatgaaagaacttgatgttcttcggcagcacaacgatgtttttagtaacaagaaagagaacataacgactctcctgaaagtgaacaaattgaaaggagacttgagggagaacatgctaaaggtgtcagacttgaaccagctgaccactaaaaaagatcaacttacccaaaaaatacaagatgcaaaattggagatgagtaaagtgaacgaagagattgctcaacttcgacaggacttgaaacaaagcaaagtttgcacagaatatgatgtggcaaagcttaaactagtccatcagctttaccaaagcatttctggtataaagttcagaaagttagttggtccagtcctatctgtatcattacatgacgacaaagttattgtgacagctgatctttcaaaaattgatcaaccgtcatgtatttcattcagtattagagaagaacgaatagaccaatttgaaagagaatttataaactgttggatcaactcttgccagcgaaccttcataaatggactacagtgcatatcaagtttgcaacgtcaactgatagatctttcaattgtcatttcagaattcaaaaaattaaaactcgtattcccggcaaccgtcaatgccccatcacagaattctcagatcaaatatgtcacattccagcatttggactataaatatcattgcaaagtagccctttctttgcctatggaaaggtttattgatttgatatgtcactctaaaaatgcgaccatcaatgttaatattatctatggcgaagaaaaaacagcaagaaatctaacgtctaatctcataaagaaatatgaaaaggtatttaaatggctctccaattgtaatatagctctttgatatggatatccgagcttttgtagcgcaagttttaggcattacgcagtatatagtttcgtacgatatttctttaaatttctctcgaatggcaatattccaaaaaattgttattctataacatttaaacagtaagatgagtgtaaacaaaacaccttttgaactctaacaagtgcactacttggctatcattgatcgcagagcttctaaaaaccaattccatagctggtgttcattgctgcagacgaaatttctcagttttttgttactgctgtcatttttgaatctgtacagtttaaacatcatcatcataaattcaacaacaagttgattatgtttggtaataacaaagcgcctggttcgttattcggcaacgcgaacacctcaacacctacaacttctacaccagcgaacaatggggttttgaatggaaaacccaatactggcacattgtttagtgctaatacactctccacgccgagccctggaaacccaacaggatttggcaatgctcagaacaacaacaacaagcctgggttgaatctttttggaaacaacaatgcttcccagaatacaccacagacgaattctctattccagcctaataacgccgctgcatcaacgcccaacacatcattattttctggcccagggtcgaatgcccagcagaacaatggtgctggcaagctattcggaaattctggtggacaacagacagctactggtatctcattcggaaataaccccagtgcgacaacaaacaatacgttccaatcaaacggattaaatacgcaacagagtggtggtttatttggtaataaatcaaacaatggtgggtcacttttcggaaatactccatcgcaaactaatagtctattttctaataataccacgaacacggcgtcaacagtcccaaagacttcactgtttggaaattcatcaacacaaggttcagggagcttattctcgtccagcaaaccaactacaaattcaacaggcttgttcaatgtttctcaactacaacagccacagcaacctggccaacccccaacgaacaacccatacggtttgcaattaagtccaaatcctgtgctgtcaatgccagaatctattactacatccctgagtaacgagagaaagcctgtctcagactcgaaacaaaatagaaaattttcaactgcatcatcagtgatcagcaacaatatattacctcccacaggcaattcaacactgatagggaagctaacttcaagacttaagaatttgaagagcagagaaacaacacatggtttgttctccccatcaaataaaaacttagcccaacaggatactttctcggcactttcaagagatgagagtaaggaaaaagggaagaatattaacaataagacaaactcactggcttcttattttaaccaggacgtttcaagcatgaaaaaattaaccattgatacagacagaagcgctgccaaaaagatgaaactctttaacggtcactcttccgctaccataatgaaagatatggacgagaaagatcataagattagtataccaaggaatgataaacttcttttttcagcacatccttcagaaactagtccaacagagccaacttcggaagtctgtctggatgaagaacacaaaataacgaataaagcaactgactattggtgctcacctactatcgaacaattagagcaacttacggaaaaccagctcacggttgtgcccaattttgtgattggtcgcaaaaactttggttccatcagttttgactatgaagttgacttaactgcatttatggatgattttgaagaactattcggaagaacaataatttttaatgagaatagaaccgtggaagtctatcctgataccgaaaataaaccggatgttggttatggtgtcaatgtacctgctacaataactttggaaaatgtttatccgatcgataaaaaaacaaaagaacccattaaagacaactcgaaaattgctgaagttcaatattttgtcaagcgtttaaggaatatgaaagaaatggaattcatttcatataacccatttggtggaatttggacttttagagttaaacatttcagtgtttggggaatggtcaatgaagaagatatggaggtggatgctgaagaagcagaaagaataaacgccgaggaaataagagacagacctctggcctttcccaagcgtcgccacagtgtgaagaagtctagcacgtcccttgaagcggaggtaccaagcaatgcagacctcacagcagcagaggctcttgcaatggagaaagaagtactagatttggttccagtactatccgactctgttgaccaagacatgtcacttattatcaaggaaaaaccttacgaaccttctgatttagacgaagatgatttgaatatcctcgaggctgcacctaaacttgttacatcatcgaactggttgcaacaattacaattagcaggtacttccaaacagtctgtgtattccaagccacttttactcaaaaacacgcaaggtaattctttggacgatatcttgttcccttcatttaagaaagatttattgacataccaatctgttaaaagagaaagaagaatcaactcacatatgtggtttgcgaagtttaatattaacgggcaattattgctcaaagatccatcacagttgtcaggctgtaagcagatcgtgtttcagtccaacttgccaataaataaatcttcttttgacaatgtgttcgcctcttatctgaacacatccatagtcaactccagaccaaatggttatcctcttgttgggaaatgttccttacagttcgataatcttgcttctgcatattctgatgtcccaaatgaagacaaaatattgaagttagcatccattttgtttgatcctctttcccttccatacgctgtcaattccccagaagttgaaaaagttcttattaaaaaacaacggcatgcaaagctctgtggatggatagtcgatgaaacaagggctgagattgattctatgctatccactgcttctgatattcagaaaatacttcttttcctctctgtcaacgacattgtaaatgcttcaaagacggctataatttccaaaaacaaacatttatctgttttgataacgttactggggtccaatgatccaattgttcgtgaaatcgcgcaactacagttaactaaatggaaatctttaggctctatagtggatccaacagtcattagtatctatcaactactcactggcaatcctttcgcttctactgcgttggtaaatgagagtaacaagttttcgcggttagtgaatttaggtttacaagtatattatggagatatcgattcattgactctagaagatttgattatgaatgctatatcaaatccatttgttgatacatcgtctgtttcaacttttgaaaacttgtcaatgaatattatgaagttatttgcttgcccaactatcccagttgagcaacttttagatgaattgagatcgcattcggagatattcgatgttcggctctgttggttctttacgcatatgttacaaagagaagatattactgaacatttgcgtgacagaatcacgttagagttcattgatcaactaaagcttgacagaatgcataaggaagctttattcgtggcatgtttcattgccgatgatgctatcgccaagaataccatagatttgttgctaagctcagaaattttgtatttcacctccaatgatattaaaccaattttggaaagattacagatttcagctccaataatccatcgtcatctggcactatacgagaagtactctggcgaccatctttccgaagtaagtaatttgttgaaagcaggcgactttaaggaggcggaactagtcaccattactaccgtaggtccaaagttaataatcaatgccaaatggaataacgattacttatcagttttggaaacactgttgcaaaggtttccttcgcacaccatcccaacttgggaaaaaggattgggtgtatatgaaaagtacatcaagctctcactacacaactccctcgatcctaatatcatccatcagcttatcaacacattacccaacctatgcaaagactattcacatcatgaattagtgaacgttgcaagctctcgtatctctgaggctgtcagtgaattgtttttgatcaacctcaacatgttatcaagaaaaatcccaaaagagagcctgctttctttaccattaggtcaaccggaatcaaattacttaaagaaagtgttgtcctcattgtgaaaacctgtattataagtatataaatgattacaacaaaatattaaacgataaaagtacataatatagaaggatatcatgaaagttcagaacccatttcaagaacttttcggatgcaaattagtattattctttgactttagacatcgcctaccgcgtcgcgtaacgattcaatgacctcgagtatcgcggtcgaagcagggctatctggaaattcatccaagaaactttctcctgtttcgcaacatctacctattcttggatccaatggtactgatcccaagaagtctattcctaattcattacaaagtgctttaccaccaccagtggtcgctttaaagattttagattctcctttgcaatttggacatacaaatccgctcatattttccacaagaccaagtatgttgatgccagctttacggcaaaaatttatttctttccgtacgtccaatagcgcaacctcctgaggcgtggtaactattagtgccccatcaatctgactctcctttaaatagttattgattgaaatatgttcatctgaagtacctggaggagtatctataagtaaataatccaagtagtcccaatccacatccttcaagaacttctttatcaaagcgtttttcttcgagcctctccatataattgctgaatccgtatctggcaacatatattgaatagacattgtcgccaaattatccgttacgtaaacgggagtccaacctgtgttcgattcatggattgtttctctaacgcatcccaacatatgtggcaacgagggtccacaaatatcgaggtccatagctccaacctgtaaatcctcgtctgccgacaatgcccaactcaacatagtggtgaaagtagattttcctacaccacctttaccagagagaatcaagatcttatgtttaatattagccaaattctccttgatcaatggaagatcgggatctggacccttcggtagactctcacaaacttctttgttcgcacatccttgacaagaatcacctttaccggcattctcagattctgggccaggacagtgttctggttcaggctctttcaatgtatagtccggaggtaaaatctgctgaccattcgctatttctgtcatcgttattcaaaactggtgataaaaaccctcttaaagactatagtaataccgagagtatagttttaacctaactttaattcttgttttagcagactggatatttatctcgttctgtaagttgtgttctttgttatatggatgaagatgcattaatgatttatcagcatttccataccttttttcaatgaatgatgtagcgggaaatactcaaactggcaacaagatgcaagaaaaatagagccttataagtcgtatactctgttctgcatcgtgttgatgatgtctgaaccaggtgattgttggttttttgtgcgagacaagaactctgaggatgagacgagggtttacatgggccattgttcttggtctgagagggatgagtatgaaatttggacccatatcaacggagtcgactatgggtacgtggccggtgaatccagcgatgatataccacacacggatatgaagcatatggttaatgcgtgtttgtcatgctctcgcataggagaagatatacaggttacaatacataagaataatgataaagtttggatactagggtataaagacgtgaatataccactagagatggaacgtcataaattggatttagaagatttatacgaagccagtatgagacttgtatctagcactaatgaaatatgggagaatcgattgaagaaagtaaccgaggaagcgttacaagtaatagagagaagtcgcaatgggataatcgatgctctaaatcagagaaaccggaagatacgagagctggaacaagaattgaagcgaactcgatctcaggttagcgttccattaggatctccgcctcaattcgaatataaatctcctgtgaagagagagttatcggatcttgacgaagatgataaggagccagaggagccattggtaccgactcaatcgtacccgttcatgggaataaaccggtcaaggactagcttgagttcatcgccagagaaacgcacgcagacagtagaatcgagtccaataccaataactgcaaccagtgatgccgtaccagatgaaggaaacacatctgaagaggacactgatttgacagacacaggaatgtgaagtactgtatcaactatatcacgtgacatgaaaagatataacggcactcagagcttgcaggcaacttgtacgtatatagaataaagccctatgtatacacttaaacgtcttcaccggggaatgtctgctgttcaagccgagattttctattccatatatgtcggatcccaaaccttctgcaatacggaagcagaaacaagaaaaagagaaaagagaaaaagacaaagtttctactcgacatctgcactgccctcaaacattcttcctcatcactttgtcactcgtatttagtctaaactatatttgccttacaatctacaattcacacaaatgtcactttacaagctgtaaaccacatgccgttcaactaatgcactatataaagagaaacaaagagacgtaaaaagacgtaaacacgggatacaattcaccagtacatattcccccaaaccagccaactctcacttctcacctctcccctgctacatcttgcttcgcattctgctcggaatctcttctttcaagccccatttagttcctattcgatctcgcatttccatactggaaaagaccagttttgaaagttttcaagttctcgaagaagaaaaaaaaatcaacaaaaaactgaaaactcgaaacattcacatagtgttttcagattggcaccacttcgtcttgaaaggtaaaggttaaatataggctattcagactaatcacaccagtggtggtttttcttataaacgattggagtgtaacccaatcactttttttaattctttcttaagcaagcacggtttttattagttttgtttcggggtattttggaatagtttgaagagttccaaccatgacttattcaccattcaaccagcagcattcgcatccacatctggatgtacaccatatggcggcttctcccgttggagaatcgccattgtcgcctctttctgatctttcataccagacgaattcgaggcagaacactgtgtggtccgaccagagtgctcatcatccgcagacccattgggatccgcatggtcagggccaaatgaacggtcaagctcaagctcagatgcaggctcacattcaagctcaggcacaggctcaagctcaggctcaagctcaagcgcaggctcaggctcaggctcaggctcaggctcaggcccacgctcagatgcaagcccagatgcatttacatgatcagcatccactttcacaacagcaacagcatcaacagcagcagcaacagcaacttcagttccataacaatttaatgagccctgtcattggatcaaatggtattggcatgtctgacatgtcgtctatgcatctaccatcgcaagagtatttggattattcaactttacaatcggcctcttcagaatttttgtctccaataccagtcaacgttatgtctgcagaaccacaagatcatatgtctactgtcaacatgattgcgcaatttacagcggaggctaacttgcctctctcgttacagtcgggccagttgaataatccaagagattttactacggcgccttcaagaacagtttatctaggtaacattcctgctaccattacttacaaggcattgttggattacgtgcgtaccggtgtagtggaagaagttaagattttatctgaaaagatgtgcgcattcgtttcatttgtggatgagaacgatgccttgttgttccattctgatgccatcctgaaaagactaaatatcgatgggcgtgatatcaagatcggatggggcaaaccgcaacctattgatcccatcgttcgtgctggtatagctaatgacggtgcgacaagaaacgtgtacatcggtaaattaaacaccaataaggactcatgtgaaaaatggggtgctgatccaaaggaaatcctagtaactaaggagaaactttatgatgatttgtcccaattcggtgaaattgaaagtatcaaattggttgaagacagaggaattgcatttgttcattttacttccatattcgctgccatcaaagcagttgcaaatatcggttccatcgatccatactattcgaacaaaaaagtattttacggtaaagatagatgtgcattcattaccaagactcaacagcataacgtggcccaattccttggtatacaaccaggtatggaagctttgatggaaaataatagagagctaatctctcaaacattgttacaacaatctgcggcggccgctgccattgccacttctgcaggaggtgccaacaatttgggcaaccgtactgtgtatctaggaaaccttccaaagaacgtgaaattggaagagatttgcaatgcaattcgtggtggtcttttacaaaatattaaacttcttaacgaccgtcacgtttgttttgtaacattcattgaccctactgctgctgcgcaattctatgccatgagctcattgcacggtttaaccattcataataaacgttgtaagattggttggggtaaacactctgggccattaccaaacccaatagcattagctgtttccagaggtgcatctcgtaatatttatctagggaacatcaactttgaagaagacgcaaagcaagaagaatccgtgtttgctgaggatactttgcgggcaatctttgaagagtttggaactgtcgaacagattaatttcttatacgagaaaaactgttgtttcatcaacttcgctaacattagcaacgcgatcttagctattgataagataaaatctaaccctcatttcaataacttaaaaataaatttcggtaaggatagatgtggtaatgttcctagacagttttgatctctgtgagtgtaaaacgaatgcactttactttacccttcctctttttctttcaaatcgttcatctcatccttcagtgcaaaacagaacaattaaactcaaaaaaaaatcatcctcacaccgcaacagaagtcaacgattgcactgtatctatcgctcattgtcaattcatctgtaaacttgcttgtggtggtgtttttcgtttatctcttctttttttctcttctctgtttgaaggtcacattaagtgcgcgacctcaaattctatccagctgatctttcacattcaaattcaaattcaaattcccattcaccatctgcagccaggttataaaatttttttccgattcattctattaatttattccatcgctatttccaacatcattaccagcatttattttttcattttattatagttttccagtacctttttgttgtcgttacactgtaattcacacatccttgtattttattgttatcattgatagatgcttatatttctaaacctcacacaatttccattcacatattatatgttttgccataaacatttctacagttgataaatcttctatatttaataataatatttagcaattctaactaactaattcttattatatccgatttcaaaagaaagcaatgcaatttatcattaattgatttaactaagcttcataatacaggacaccaaatttctatccagctttgccaatcgtctatcccatccgagctttaggccatccaacaatacccatcaccgtctggcttcaccattctatgacttttgctaacgtggtcgatttttttagttttcgtttttcctcaaagtcggttttagggtatataaaggatcaaaaccaataacaacacattcctttccatgaaagtctggagatctaaacaaaattgatgtcaacataaagccttagaacggatatttcgatacagcaatcgtaccaaactgttaatagtgatcctatctcatatttaagcgatacattgatatattgctaaagtacaagcataatagctggaaaaaaaagacaacccttatcaaaggattgattaaacaggataatagaaacattaagggacatattctgaggagaaggtgactcaaaaaaatgaaaattattagcaagcgcgattcagcaagtggattgaatgttgcattggacctagaaaagtggactgttaagccaatgatttacaatgtcgccgaaaagcaatgggaatacactccagatctagaggacaaagaggtggagaaaatccatttcaagttcgttgacagcaacggtacttggtttgcagataacgactttccaaaagagtttgataatattgggaacgaaaataatgtaatctacgtcaacggtaaaggcttagagttcaaaaattacgtgaacgatatcaaaaacgatgcagattctccagctagtactcccaagaatgcccgttttgcatctcctagagaacagaaaccagaggaaacgaccaattcggtaaaaaaggaagtaccggtagacgagggagttcaagctgttgaaactaaaaaggacactgaaggatccgccgataaagctgaagcaattcctgcacaggaacaactgcaggagccacagaatgaacaggaaagaccaactacttctgatacggctgtaactcacagaagtgactcagttgtggaatactcgacgtttttggatagaataatgctgttcctaagaagatttataaaaaaatggttcacattcgaaagatcttcttcgccaacttcctgatctacaatttaccccatgtttaaccaccaacaacaccaaataattttccttttcacgcagaagaagaagttgtcatcaatatctttatcatatgctagacataataactatataactaatttcacgactacagaagttttaatttaggcttcctttagtatatttcgttttagttttggtctgcaaaaggcaacaatttttgaagtaaaagagttgggtataatcatatatttgttacgtatatcaatataataggtatatagaccacagctatatttcgtgaagcaatctaatggttcacttctgaactaaaaggaattcgtttggataaataaaaaaagtataaggaagatgggtattgtcttttggaagaaattagatagacgcattggaaaacgagtcaaaaagtcaatttccttctaattcagaaaattggttggccaggtcttaatgtaatccaactccaagcactaggtttggcatcagcctcggcctcagggttggcttctcttttaaagattggttgaccaggtcttagagtgatccagctccatggggaggcatctgcattggcatcagcattagcctctctcttaaagatcggttgaccaggtcttagagtaatccagctccatggggatgcttcagcattagcgtcagcgttggcttctcttttaaagattggttgaccaggtcttagagtaatccaactccatggggaagcatcggcttctcttttcttcaaatcatccttgtcagcgaaagcagcttcagcgatggtggtgtttaagaatagaataccagtgtgggttccgttattaacaggcaacaaggaaacttcatccccggttaagtcaatgaatccaatcaaggcttcttctggaaccgaaattggaagatcgtcgatgtcagtttcggtagaaactggagcagccataacaacggaaattaaagcagtagatgcggctaatatagtagagaatttcataatattggatagttcaaattggatagttgggtttgtataatttagattaaggtgaagttcaggataataaagacagaaaaagatcagacgagttgggctttagatgctctggtttgcttgttctaatatactatattgaaattactattgaaacaaacttagaacaataccataacatcctatcaatcaagggtcctttatatatgaattttcccgaaatccgatcacccagtgagcttgaacagcaaaccatttcgtcttaaacagataacaacctctaaaaatgtcactgtcttacgattcacaaactgcagacatcgaaattgaagtaacagattagtatgaggttcaaaaaccacattattggaatttcccctcttcatacaaagcctgtcaaaattaacttttgcacactactgtatagtttcaatacataacgagctttacatgacagtttaggaaagagcactcatttcataccgttcaaaagtctacttcagggacacatacaacatcaagaaagaaaatcaaattgcataagctgcaaacttaagcatggaacctcattaattaccggtaatatgttttcccattcaagttgtataataccttcctaatttggtctttaaagcagttacagttctcattcatattgaaacagacagaagaaaaagaaatttaaggaccacaagggacagtgtatgaccaaaatggagtcaccacataaactcggttggtgggagcctgcatcctttaatcattaacctttcatggtactttggcaatatgttgaagctatcacttgctatacttgatttaaactctactctaccctggaacccttcgagagatgaaaaaggccgatcctgtcgcaaatccgggtaatataacataccaatgaaaatttttttatttccttccttttctgtctttgtataaagctgagatcatgagcattaacatcatccaccacacttcacttttgtttaataggttttactttagttatgtatttatttgttgtttttaaaacagtaacgcaaaactcacagacattcgcagcgcataaaagcatcctcttgaggttgaacccctccggggcgttcttggcccatgaaaagttgggatatgtgttgcagtttgcataactattttcggatgtactggagaacgaatcccatcgaatggtcttgggtgcagcgactcatctgttgcttggtcttagttaccaggtctaagggtttaccttcgtgtgcccgtatgagagtggctgcaaggatcagtcgaacaaaccagttaattaattttaattattattcttaattgaagtatgtgtgtattagcttctggtagtatatacatattacgcaggaagaaacaggcagagtaacgggtccagagtaattaatctatgactttgaaccgaacctgaaacttgaattgaaacccaatagctcattgatgcctttaatccagtcgttttcagtcttggccacgcagtagattccagagttcttgagcgatgtcttttgtgacttgattgcttcttgaggtattggtaatttggacccattcacatagatggttcctacttcgttgacgacatgaatttcatcgttcacgtatacatcttcctgaggaataccatcgatggataatttcacaacgcggccgtctggaccgccagtgtgtttcgaaccgatttttatcttgatatgagaagtgtgaggtaagatcaagggacggaacgaaagtgacctagggcaaatcggggttaataagatcgagggaaccaagggagacacaatacttccgcctgcagataaagagtatgccgtagatccggtaggcgtggataaagtcacaccatcggcagtagtccttgtcataaactcaccatcgatgtatatatccaaattggtcaaatgtggtgagttacctctatgtaaaaagatatcgttcatcgcatgtaaagttgtagtttgctgcgtcttgccatttcttaccaaatgacactctagtctcgttctatgaagacatttggctctagaagtcatcacttgttcgaagattttcttatgctctttgaaagcaaacggtagtaggaaccccaaagttcctagactgaaggcaagtacaggtgggacctgagtatgtgagaacaacgaaacggatctgagaatcgtcccatcgccaccaagagtcaccaagagatccgtctttttgacaatgtcagcgtccgagcccgtatatagaacatgcggttgatttggattcgatttaggcatcgatctgaaatcttgtgatatttcttctgccacatctggttgcactataacgttgacttctgggtaagaatcgtgcaagtgtgtgatgaactcaaccatggcctccctagtggtatcagtccaaggtttcttcattaaaaacacgttttgcataggacggtgccatatcaacgattgtagtttcgaatttggggaagatatgaaatctggcaagctggttgcccgtagatcgtttacatctttcaaagcaacaaacttcgaagaatctcgaagtcttacctcagaataaaacctagcgcactgaaacaaacctgaaacatgctgctgacgggccagtgaccaaatgctaggaacatttaaccttcctctgagaagtatcaccatatctcttgctaatcgttaaacaaaaaaaaaacaaatgaaatcacttctaatcacctaatcttctgtctcctactctgcaattgccgaatacagtctgtatccaatgaactgtagtctgtagaaacactactacggaccactactaaaacctttgtaaactcttttcgttaggaaacaatttgaaataatgaattcttatgattcatttatatgaaagttcactgcaaagtcttccaaattgaaagtttctctggatgaaagaaacagtcgaaagaagagtgttaggagcaggaccaaaatgtagaccccttttgtgcgtgtgactctgcgaagaagagtaagaatcggaacggttgacctaggcctttttctatttacaggcacttgggcgaaaaaaccggctttactatcgatctggtggtggttgtaaatctggtggtttgatgagaaattcaaaccagcaaatctcttcgaaccttgtttgaactaatttacttagagaacagtgcaattgagtggatcatgatctaaaacaggacctgacttctcttaagcaagatgatacttttgagtggagggcacatcggcaggcgttgcttcattatacattggacaatatgcttattatgcgtacgaaaacttttgggagcccaaaagggcccccaaaccagttgcgccaaatacacaactttatacttatttactctcatgtgtatatatacatttagtacctgctgtaatttcactcaaacgtcgttccctcttgtggttgtaacaattttttgttcgatggtgttgccatttccttacgtagctccaataagacagtttccatggtataggatcttttccattccttcaaagtatggaatttctctttgacgacctctccggtggtagaattgacacatggcaggttgatcttcgatacgaatttcaccttaggtggttcgtctggatatgagggcccgcattcgatgagcactgaatatattctgttttcatggttgctatgaggaggaccaagtatggtaccgttccactttgtcattgtgatatcatcggagtcagaaagaccataggaacaagattctggacccagtcctttttctcccttctctagctcttctagtagtctgaaacttcttggtctagtgaaatatgtatgccatagtgcggttagtaaaattctgaaagggttgttataggcatgggtatcgcatgaaagtaaaagaattcgaatgaacgtacactttagacatagtaagaacagtctggttagttagcggtgtgagcttttgatccccgtcccctttcttgatcatctttaaaggggatgatttaaacgtttcttcatttcattctgattttataattttatagcgaaaatcttgactttgatcttgatccattaagtgatcttaggggaacttaaagaatgcttcatgccaatagtgtcttgcaattgtgtcaaactcaattgtgtattatatgtcactaacacctcagataaaggaaaagccccttgaatcgctagatgcagatcagttgagacgtcgcgttttaacgcttcagtacaaatacacaaccttacagaacgagtatgaaatttcgaagttgtcatcagaacgcgagacttattcgcttcagaacaaatacgataagagtatgaacgaactggaaaatgctttgaaagataccaagatactatatgaggaaaacatcaagttgaaggaagaattgaaaagtaaggatgcgttaccgaaggaggatgagaagatcataacgacacttcgaacacaggttgtaagtttgaaaaacgaagttaatttgaaagagcagcgtatcgtggaattagctcataagctttcctcaaaacaaaatgaagttacgaatgcaattgaatcgatgaagttggaaattgaaggtagcggaaacattctgcatcaacatgaaactcagataaacaaacatgtggaagagatacgatatttacaacaagaactgaaggaaaaagaaaatctgatatctgaactacgatcagttcaaacttctgcgtctcataggaacaattctacggaagaattacaagatttggctgtcttgaacaagactctgaaggagcagctcaattatgccaaagaactagaggatatgaaccttaaacaagccactgaattgaagaagcttcgacaaaataacgatgtccaatcgttgttgaaaaaggaaaatgaattactccagtctaaactcgatcaattgaattctttacaaaaaaagttcgaatcattggaaatggagaatatcagcctacaggagaagattacacaatggggtattgttaggttagacggtaaattcaagaaccctaacgatgttataacagagcttaatatgttacaacgagaaaatactttccttttagatacgaattccaagttacaaattgatttcaatcaaatgtccatgctcaacgatgagatggcaattgaaagaaaccaacttctagatttgaacaaagactatgaaactagtattttgaatttgaagcgtttaaatcatgaacttgaacaacaaaaacttttgtcatttgaagagtgtaaactactaaggcaacaattagaggaatttgaggagcaagacgataagaagaaaacacccggagaccaggtaaatgcttcaaacatcatcgaagggtacaaaaatcaaactgaggatctaaccaatgagctcaagagattgaacgaagaattatcaaaaactgacgataagattcaaaaacgtagaaaaataaccaatgatttgggaataagctattctcaaagattaaatgagctaatactggagaacaaaaaactggagagattactttctgcgactaaaaatcatgcgaatatcctagaacaaaaaattttggacttgactagtcttaaagagaagaaggttagaattttacaacttcgtgataatccattgttaaaagagcattatatcagaaaggaaaagttggcattacttgaaaaggaaaactccgatctattatctgggatagaaacagatgccatcccaagatctgtttatgatcgtatcaaacacgacatgaaactacttgagaaagagattttctctgcaaataagaagaccacaagactaaaagaagtattcaataagaaatcgttagagttcattgaggccgttaattcactgttaggatttaaactagaattcttggcacatggtaaagtaaaattagtaagctgttatcaaccgaacaaatatattattgccgatttacaatcgaatacgttaaaatcggatctagataaagttattcctgaatgggaaacgttatttcaattgtacgttatagaaaagggagagttgccagcgtttctctcccaagtaaagcttagactgtgggaactatctcagccttagctgcgcgtcacaagaaggcaggactcagtgtaaatcaacatattttaattcattgtatatactagtatgtgcaaatatctctctatttacatatggatcaacttgacgaaaaaagattcagacatatatacaaacttggattgtcggggatattatatgacatcacttcctatcacaataccgaaccgcagcagttcatcaaccgatgattgaggtatgactgaacagcgtactgttacaaataatgctacccattatttctatcctacagtcctactattttctatattattgactggtggtgttttaactgctacttctttttacaataagcaccttagacagtataaatctgccaaagatataccggaagcgatattcaagaagcaatggctatatggtaaagtaacatctgtgggagatggtgataatttccatttctttcatactccaagcggtatttttggcggctggggatggttaaggtccattcctgagttacaaacagtagcgttcgacgcttctgttgaagtaccacaatcagttcgttggtggaacaaactattcagtgccaaagtagctaactataagagtcatttcatgagtttacatgtgccatataagggcagaagaaatcttcctaccatttctgttcgtttatgtggtgtggatgctccagaaagatcgcatttcggaaaaacagctcagccttttagtgatgaggcactaaactggctaaggtacaagattttgggacagtacgtctgggttaagccattggccgttgaccaatacggcagatgtgttgcacgggttgaattgtggtcctggttgaagggatggcagaatattagtattgaaatgctaaaagagggagtaggcgttgtttatgagggaaaagttggcgctgaatttgataaccaagaggatatttacttatatgaggagttaaactcaaagaaggcaaaacgtggattgtggtcacagcggaaatttgaaactcccggtgcatataaaaaacgcacttgaaactgaaatcaataaaaacaaaagatcattatttcaacagcaagttacaataaattatcttcgcatcttaactggcccttggaataccatgaaaagtagttcggagaaaggcttctgatcgttacttcgttttgtcaacaaactctggaaactagactgacttagtcaaatcatatttatattcattccatgtagtatattatttaacattttacatagataccggctctcatctcttgggctctgaattcgaacatcaattgtacgccgacgaaaagagcacagttagctatggcgaaaaacaataacccatcaaatgtaccaaacatttctttgaaaaacagtaaaattccatcatgtcctaaacagaacccgaataagttagcaatcatcatcatccaaatgttcaatactgcaccacaagcacaaacatgcctataccaaggcttcttactgaacttattaaaatatctagagagcattatctctggtagcaaaaagagtacaaccaaccagccccatagtaagagttttagttcaatatcatgccagatcgcgacgaatgagaaaacagcaaatgacgttataattctatttccagacccacctaatgggatatagatatagcgaatgacccatttattataagatctgtgccaagctctccaaaatgcaactggagagaaattgttattcatacaacgtatcatattttctggtggatcgataccatccaaaagtgcccataatctaaataatctccatgggataagtaattttagccatattaaatttagattaaataaaccaatcatcgagatttggaatggggagtcaccattccatgccttggtctttgaaacagcaaccacatatacgaagtgaagtaaaaattccattatgaacaaacagaacaataacctcagcgcgtatttgagaattcttttaaagttgatggaaggtaattgatgagaagattggtacaagtaatcgttaaaagtcaatattggtccagcaataaataatggggtataagtaacatatgccaaataacgcatcaaggaatattcttgaatatggtgcggtgcgataagtcttgcacgctcatccaacaagactgatttagtagcattttcttcaatagtttctagcacttgggtgctggaggcgcgtttcatctcaaatctttcaggtgaaacgctatttgacgcaggaacagtcgcggggttggaatgaatcttattccatctttctaagaaatccatatcgaatgagatcattctcaataatgtaaaattgtaaaaaacgtcccatctttcaatgatacctttaaatgaatggtccaacggtttcagaagcggtattatctggccgtattgtaagtttctataggaattgttaatgaaaagggagccaataccatatatccacacactcaaagttgccaatgctctttgcctcttaaatgtcttggctagggtgaacattactagaacatggaacaaaacgcgcaagcagtttacgccatgtgcaccaattaagaaaactaacccaaaccaaaaatcaaacgtcaccttttgtacattggtaaattggagcacagctttcttgatagataaatgaagtaccatcagacccaccagtaacaatagattatctctaaaaaatctatactgggcatcgctgttatcaacttttcttccgaacatccatcccttactcaacaaatgctggtacttgtaatagtttgaattccatgagttagtagcatccattcctgccttaagcatcaacggtagcactatacacaagattaaccaataagccttgaattctaatgacgaccatctagattgaatttctggccccaatttctgtttacgacgagaatcattcgtaggtgccgtcaaacgttgatctagagtctctagcgagaagaaatcctgcacgacggacacaattcccattatctgtatttttgtcttggagatctctattagcacaccttataaaccagtcgcgcagcaaataaagtctttagattcaaaagtaagtcaattgagggttgaactctacacaatgatataataatcccagaaggtactggtaccatataatgtttaaaaaactcttcaaaaaaacctcatatacgaatgaaatcacttttacagtttatattttaagccactgaatctaactaatgatgatacaagcttcccttacagaaacgaattaccgaaaaacctttgttcccgtttgtttctactttgttacgcaaatcctgtatgtttccagatggaaactcggaccatttcgcgtacagaacgttattaccaagttattccgctcgggtctctccagttcgaaattcgtcgttcccaaccatacaatttctcctttgtttcgcatatgtttcctacagccattcggtttacattgaccatttccgttaagtaattgtctgttttgcccaacagcgtccgactcgaaaaattatgcgatgtatgggtgcggaagatcacggcagtagtctggcatcttcggaaaaagactgcccacacgtgaccgagtcggaacattgcgtgccagaacgtttcataacgagtcggtttttttcggagaaaatgcgtcagaaacgggatgggaattggaaacaagtgcgaaacgacgtagaactgatctacaatatttatcttttttcatcgtctgaatgctaacaatgtttgtaagttctttttaacaacgatgtcataccgataagttacagataaaacagaataaaggggagggactttggtttgtaggtttggaataacttaaacttcataaaactatatacactggctttaagttccccaaacttaagaagtgttgctttcattgactctttacgatgttctgggggtcgaaaagtgggataagttccaagtactcatattctaatacaccgacattcacggctgaaccatggtctgtttatactgggaaaccgaaatcatctagcagtagtaatagtggtgggcccattgataaagtttcagttttcatttttgataagaaacaatttgagagctacttgttgcattatgggattatcaaatctaaaaattcatctcatgacaaattatttcttaacgatgcgtataccgtgttaaggaatcaagttaacaatttggctaaattcaagcacccaaatattttgcaactaattgaaccattggaggagcattcgaagaattttcttttcgtgacagaatatgtttctggtagtttattcaaccttttccaagagcaagattcagtgacttcaacattcggagaagaacttttacagtctaatgataccaataatttgaccattcaaagaggtatattgcaggtgtgtcaggcgttggatttcattcataataaaacttcatctgttcatcttgatatccaacccagatcagttttcgttaacgaaaacgcggattggaaactatctggccttgggcatttaatcaaattacctgagggtaccaatgtcggagattttacgataccacaatacgatccaagggtaccgacgtttttgcagattgatttaaattttgcagctccagagcttgtaatggaagacaccttttcagcaagaagtgattatttctcattgggtcttttgatatattatttgtactatggaaaatcgttgttcttgtgtgagaattcaaaacaaagttatagagaccagttcacgaaattcgaaagaaaaattgcttccttgagttgggacgcagtgttccaaaaagtaccacagacacttagattctgtttacctcgtttaatgaaccgtgacatatattccaggtatgataatatcgtggaatttttggacaacgatttcttcaaagacccgctgatccagactttaatcttcttggacgatctaccaacgaagaacatagatgaaaagacaatattcttaacaggacttataacgctcttgccaaaatatccagcacaacttttacaaaaaaaattcttgcccatactactgaacaatttggacttgttgtgttctatgaaggaaactgctgatgaatgtcttcaaatcaatttggaagtgatattgctcatcggtaagaatttgtctcaattgtcattcactgagaagatcactaaccatatcataggctccgcaaacgggaaagtcatcttggaacacggtgccagtggactaatcaaacacctttccatcctacaaataaaactaaagaaggacgcatttgataaatcattattgaaaccattatacgaatatacatgcgaatcgcaagaaaaccctaacatacaagagagcctactaaatcagttgcccattgcattagaaacattcgatttcgctacggtaaagaactttctatccccattgatacagaaattgtttacaaagacgactagcctgactgtgaaaaatgcatgcatatcttgcttccaaactatgatccaatccaacgcaatggatacctacatgatccaagagacgttgttcccattgataaaatcaatgaagagtagagactcacggattctaatgaaattcctagaattcttcccacatttatacacagctatccaagacaaagaagaactcatcacagaatcgttcatcccgctaatgttcgcattctcaatggccccaacgcttaatacctcgcaattcaactcctattctaattcgttcaacaacattgtatcacaaatacagaaaagacatgtacaacagttgaagacggaacaatctaaatcacaagaactggaaagtaaagatttcacgaagatcatagatacaccaatcgttcctgcacgtactgacacggacaacgaaatatcgagaagtatcaacgtcccagtgataaaacctaaagcatctccctcatatcaggctacaggaatacttacaccaactactaatgataatagaaccactactggtactataagaagcggcggtcctagtagaggcgtaccaagatcgatcaggtctccaccacagaaaccagtcaaaccaacccaaccgattactacaagtgacattccagtatcactaccacaaaagtcgccatcggtacctacctcagtacctgcatcaccatcaccatcattatctctaccaccaggatttggcatagctctccagcccaataagaaagcttgaaaggcagattactctattttcattacccggacttgcccaccctgatatcccgtgcttcaagtacatttccttccccatgaatggctctcgaccgatatctcgacgaggaaattgtaagtgaaaaaaaaataataaaaaaaaaaaaacttctcacagctcaatatatacagcttgtcttgaacttctttaactattgacttctttaccttcttcaacttctgtttacattcccactatttgtctaatttattttatacaatttaactttgattcttacccataattgctgtttctctgtgtttgctgaatcattacttgactgtactaaggattaaacatcgtgggttacacatttgaacatatttatacacatcatacacaatgcatatgagagctgctacaaggaataacgtaacgaacaggttgttcatgactacttttctggtcgcattttcgagcgtggcattgagttcggcgttgccatgtcctagccatacactagattctgattctccagttcttgagcagaaggatgcacagctacaggcgcagaaacagaaacaaacatctcaagataattaatggactggaagctcacagggggccatacttccggtaaatcaatcagattgttcacttcatccctcattattctcctctttttttttttctactgacgatacatgttggaacgctgttcttattggtaggatagagcctatctgagagtgcagagtttttttatgaaagcttaagacataatatatatatgactgccagctgccaacacgaccagagaaaaaagagccctcaaattatgttttaacttattattattattattattatcattatcattatattcattcattcctgttgttggtgtgcgttttgtgtccaggggacatcgtgtgcatcgtgtaagaatatccaatcagggcttaaaacactataaacggacttttgtatttattccactcccaggtggttggatcattgcataatatttaaatatctacccctacctctgtgtaaatattgaaagatagcttcaacctaatcatgtcctactattctaatgagaaagataaagatcgatgtgattatgtcagttgttacccggtgtatctgaaattagcatttgattttgacaaatcgagaaaagcattagtttaaccaattcttttcactgtgtatatttaaggaatgctgaaggaatcaagttgtaccaaacaatcacttgcctgtcactggataatactagtggacatcacacgtcaggatagttaccgatacattgttagtattttttttccgtcttctcgaattcttttctataaaaagatacgaccataaactacaaaactgtatcttgactatttcccaaagtatattcttgataacaaagatccacctgaactaacgttatacaacgctcttgtgttagctagttaccagccatgtctgtcgaatctgcttcaaacaagagttcagccgaacctgcccagggggagacaccgattctgaataatgaagaagtaactgaaattacacaacctgctgcagtagaaacagatggacagctagagcatccagaagatggtagcaacaacactcctgttaacagcgaattgcaggcaggttcggatgttcaagcggaacaaccaattcatgtagaggctccagaagaggttgccgcttctgaggaagaacaacaacatccagatgtccccgaaactgctgtggagcttaaaggcgaacaagaagaagtcaataatggtgctggcggtgcagaaaactctcccgtttcttccccatcttctagttcttctccttcaagtagtgacactggtggtgacgatgatgaagtcgaaagagaagaagaagagcaagaagagaaactgacaaacgatatcgaaagtgaggaaaaacaattgcctggagaatcagacaatattgataaagctctccttgagaaacagttcaaactaatcaaggaagcttgtattttgcaaaacccttctttcaaaaatgcttccgagcaagaacaaatttctgctttaattgctattctcaactctgatcctcagacagcaatgccgcatgcggctcctgttgccacttctactacaacggcagcatccgaatcaaaaggcaagaacgttcgtttcccacgtccaaacatgtcccagccaatgtctgccgaggagaaggagagatattcagaatatttaaacggtgagactaagattacagagattcaatcttttccaccaaaatcaagattgttcattggtaacttacctctgaaaaacgttacgaaagaggacttattccgtatattctcaccttatggtcatatttttcaaatcaacatcaagaatgcttttggtttcattcagtacgataaccaaagatccgtgctagatgccattgaatgtgaatctgaggaaatgaatttcggtaagaagctaatcttagaagtttcaagttctaatgctagaccacaatttgaccatggtgaccacggttctaataccagttccacctacgtcacttcaagcaagagaaactacgataacgaggaaaacgacgatgaagacatgtacagcgataatcattacaagaagtcaaagaagcgtactccacaatgtctaatatacgtcaagaaggccgcagatcgtacatatgcgtacagtgtttttaccaatttaagcaaaaaaaccggtttggaaacggatatggtaatcttgaaaccaagaatggaactaaggaaattggttaacgaagcagcatacgatggtgtgtggggtgtggtcctcgtgaacaagaacaaaaacatcgacgttcaaactttctacctgggtccatcaggtgaaaccaaatccgacgaatatgttgctgtttcgattgatgaagccatttctattttcaacaatataaaggcaacgaaaatagggcttccagcaagatcacctgtaatgaatgcccaaccgtatggaatgcagccacataacgtcatgccgcagcaaccatacggatacatgcctccgcaacaacaatacccaggtaacatgcctatgatgcctcaacaacaaatgtatggtaacatgccacccacccaaaactatggaatgccaccaccaccacccccacaacagggccacggttaccagggatatccgcaacatccacagatgatgccacaacaaggcggacttgatcaaaaccaattgttggctgcgttacaaaatcttccaccaaacgttgtcttgaatctactgcaactagcccaacaaccaaatcaacaacagcagcaacaagcgttaggtgttatccaacaaatacaagctggaataccattgcagcaacagcagcaacagcagttacaacagcagtcgcatcctcagcaatcgccgcctcaacagcctcaacagcctcaacagcttcaacagcaccaacagcctcaacaacctccgcaacctccgcaacctccgcaacctccgcaacagcaatcgccttacggtaattacataccaccccagacccaacaagataaccgttcctcccaagataacggtaactcccaacagcacacccaaacgcaagcacaggctcaagcacaaaataacaacaacgtccaatctctcttggactctcttgccaaactacaaaaataataaggaacccaaacgaacttctttgtatactatcttcatcttaaaggaatcttcttttttacatatcttgcatacatcttctactatccctctctcgctctctctatatgcgtttctgcgtttctgcgctcctgcatctctgcttgtttccagccttcaggcacattacttctcaaaatctttagatctctggatctctggatctctagatatctacatacctaaatttacaaaccggtctgatatcgaaagaatcgaacaagccggttatccagtagtaaatacatagaggggccaagaagctcaagaaattaaagaaaaaggcaagctaagagaagctaagacataccaaggcaaaccagccaggagtcccttgcagggggtcatggcaaacatccttctacacctgtttccttcatactttgttcggaaacggcactgccctttttctaatggagcgcttctcggccgcactgtagaaaatttctttatatttacataatgaatctctatataatagagcttaagataatggaatctggaaaaagtgtcagtgtaagaatataatcagggtgtggagagaaaacagccggttaaggtccgttacagttgaataaaacactcgttggtattgattgaccattctgctaggtgcaggtatacttctcgagtatggattctacgtttatctccaatttaaagagcgctcctaatgggcttctttccaaagttttgttggttggaatctttgtcaatgcctggtacttttattacctcacttttaattcaagtaaatctaccggtattagtttcaagtatggtgacagtttcagtgaggcaccaggtgctgaaataagtgtttcaaattttagagattttgttcgtcctttggacagagacaacagcagtgccatttttaacactataaatgacgccttgaaacaaagaaattctgacattcattctgttggtgtttccttcatccctgcggtgattccacagggaacattattataccatgctggtgtaagtgaaattcctgattcgtttgaatgggttgcatttgactatgagtttagtttgaatttcggaactagacgtcagtctaggggtagagcctcggggaaccgaaactctaatggacatgggcctggtggtggacctggtggtggacctggtggtgcaaagcctggtggtggacctggtggtggacctggtggtgcaaagcctggtgctgtgaagagggccgaaacggaagaggagaagaaggaccagaacaagagattttctcagactgccagtttgttgacgttccaagctactagagacttaaacaaagttataatatttgacggtggtagtgcagccaagagtacttctggcgaaattgacacgcagcaattatggtctaatgttattgccaagcaaagtggggatacgacaaatgacaccgagtaccatatgcctgaacgtttgtacgccagtagaatttgtgaatggggcaaaccacttggacttgatggtttcatcagagttgaacttgccttcgaaatggtgatttgtgattttagtaggggattagaacttgtaagcaacacaaccatcctttccaacagtgactttgtgggattaccaccagctgtttccttaaccaaggagaacggatggccgattggtgatgatggaaaaatcattgaagaccagttgaccgacgaacaaaagaaggttttggatcaagaagacgtttacgataaatacttaggtgaattaggtgctggtggtacctacgatcattctaaggctggtcagttccgtgatgaaggtgagcgcagagctagaattgatttcagatatatgattactggtattaatagaacgtggctaaatcctaaccctaacgcaagaagattaatctctgacacggtgccattttcactgcatgaagagattgttgaagatttgaaacaagtcttgtcctcagatactggctttgattggcgtcaatccactgactggcaaaacgttgctagagacattattggcaaattcacaccaatgcttttgagtgtgcatgacactctcaaatccggtaccggtactgccgcggaaagagctcggaaggcgtcattatactataccaatttcgttagaaggttccaggatactgaccaatcctttgaaaaaagcaaagagttcgctgtttatcaatacgctaccccaatggtacctttaagaactgattctgactttttgatctggtctgcattcgtcaatgtgatgacagatgtcatcgatgttatcttcggtgctgagaaatctcttcaatcggtaattaatgcatctttagaaggaagtacacctgctgatattgacaacgtggttaacgatgtcatagcctcgattcatgaactgattgtaaacctaaaatgggtcgaattaagctatcgttgcgctgagaattgtggctacgatggattctgctatactccatcgtggggcccaagtgcatttggatggatgaatccaaatgtgaagaacaatcctgaaacaggtctaaggtgggacgactccattaaccgttatgtcgtcgacgaaaaacaacaatgtgttaatctcgacacaatcttgaacttcaaacgtcaggcttaatgactgccctttacgtacgcacgtcattccgtataaattttaactagtatacatatatatatatatatattaaacagttgttgtaattctgtaagataagataactaaattaggttactcctatgaggtacagcaaagcactcgaactgtagggtgtcctggcgtccgtgtactcatcttacttcatgcattgatcaataccgatgttgtcgaattacccggccgttcgcgcctagttgcgtttctttattttaaggctattgcatcctgcatatcggaacaatcacacctacaatttcttatacccaagtaaaattcaactaccgacatacagatctcaccaattggtgtcgttgcatcttcaatcagacatttcacatattaagaagagtgtttattgagcaagttcagtcaatcgctttatttcagatcacaagagaaccacttttataattcattcctcccacccctttgctgcaatatggaatttgaaaccaaaacaataaaggtcgatggtttgaccaggaacatcttgctccagaatgagaatggaccatgtgcactagttgctttgacaaatgtgttggttttatcaccgcaacataagttagatgctaacgaattgattcaactaatcaattcaaataggaaggtgactcttgaagatttgataacaacattggcaaatatcggtgttatgatggacaatggccagtcggaagatgtgaacgaacttttacaattattgccacagctacatactggtcttaacgtcaatccggctttcaatggtacatttcaagatgatcaagcgttagcactttttagactcttccaagtgtcattggttcatggatggatagtggatccaacaagaaacgaacaacaataccatagcgtttctcattactcttacgatgatgctcaaaacctcttggtgcacgcttacgacatccagaataatgggctgcaagtggaaaattcggagcaaattttgcaagacgctcaatatctgaaatcgttcttagcaagaagtgcgactcaattgacagagtatggtattcagcacttacagcagctacttcaagagcattcatactccgtatttttccgtaacgatcatttctccaccattcataagaacaatggcggcttatacgtcttggtcaccgacttaggtttcaagaaggcttctaatatcgtgtggcagtctttgaagtccgtaaaggggaaccaggactctttcttcacctctgagttcctactaactacccttgaacaggccactgcttcgggtttggacccgaatagcaacggatctcaactggatgaagaaacaccaatgacagatgaacagttggcccgtctattgcaagaagaagaagacgcaagggctgtaagaggtattaggtcgcgccaagataggagggcagctgctactgcctcttcaaatgaggccaaatctgctaagaagggcaaaaataaaaaagccgaaaagaagaagaagaagaagtgcgtcatattataaagaactcagtgatcttcattatctctgatctttctaaccaattcaaactctgttaatacaagaagacaggaagagcaattcagcggtttcttacttacgcacttacgccatttgtataactgatgagtctacacttatgctaatttgtctgtactgactttaaccttatatatctaaatatatagctttacgatagagagacccctgtttatgaatgatgaatcctgtacgaaatagactggatcttgaattctgctagtccatattttattatgtatcaatgttatataaactgtgccagtgcatattttttcacaatacaatttcgttgttcgatttatcgtatctgaataccaaagtgacagtaaaaaataaaggattcttcttcatcttaaaacaaggagacgttttaaagacactaagggagatatagtcggacagttttcgaaaaaggtcggtagcataggcatattgttagataggacagtgtactagcacatttacgccttgttaaaatagttacaaattagctctacattctcagatgtatcagtttattaagactccgcacacaacaagaactattgaatttaatggttctcatggaattgaggttattattgggaaagaagttaaggaagatgaaagcaagcattccagcgagtccaatttaatctttgatgatgatgacctatttgttgagcacgctaagcttgttgttaagaaactccctccgacgaatgatgaagagtcgcttccaatgaatatagactcattcaggatttatttagaatccttaggggacgcggatcgtattgtggatttggaatcagcagattccaatacagatggaaagataattgatttgaaaaacggtgataggtttgggttagttagattagatgagccggtctcagtgaatcaacaacggggagccaaactcaaattcaacttaaatataagaccaggagcttggcctttcaactacagaattgtgcttactgatgtgacagatcaaaaatcgccatgtacatcaaggtcaagtgactttctggactccatcatgcagcatgtttcagacgaatctgattctgagaacgcatggtccaaggcaaccgattggaacgaggaaattaaagttgaaattggcaaggaggatgaagttgttgctgtggtagatgatactgcgccaacggtagcactcaagccaacctctgaccccagtacactgagctcgtccaaggagtcgtctgtttctggtaactctcactctcgtgcatgcatttacatcaacagtgacagcgacagcgacagtggctatgatgaccatacttttatggatccagagaagaagcaccatcacttcaaatgccgctataagagaggaagagggaacagatcaaggtggtcgacgtttagggtgaataaggctaaggggaagaaatttggtagaaagagaagatttgacttatatagtggttcattaggatttatgttgggttccattggtactttgggagttttagctactgttgcaaattttgtcgaaggataagtttggattgttcacccagctgataaatatcattgaatgttccaacccacactctcataacagttttttagaatgctttattgaagatatcaaaagtatatattttgttattatctatattatatgtgatacctcatgtctgaaacccaaatgaaacatataaatgcttgaaaacttgaagagaaaaggtctttataaagtgaaaatagggaaaggaactagaataggcatcaattcggattaaaaactacactcccggagtggtcagtaatccaactcatgcaactgagaatggttgcttcaaataatggaatgttatcaaatcaagatgaatcaacttttattgatgagcccgccatgagcactgatggtacacagagaatactacaagtcagttcccccaagatcgatacagataatcacaatatagagtacgagagtattaaaagcaaggataagaagaaacataagaagaggaagagcaagaggcattctaaaggaagacacaaaatgaaatatcgagttgacaaacctcggtaccacgatgatgcaaaatatgacgctgatattgctgacaataataacggaaaggcattgaataaattcttccctggtatcttaataggaactttcattggttcagctgtcactaactttatattggaagggttaaagtagtaagcaagatttcctttttcaaacctcatcaatcggtcttttccttgaatggtttcggtattgagtatcacgttgattgagttgcctatcatacctcctattggagcgtctattctggtcattcttgtgatctttgcctccaaagagcacctctttttcttcttctgtaagttcatatttgagataattggcatcaccaagttctttgatgaaatccaagatcttaccgttttcctcttttaagattctctgatgaagacctatcgtcaagtttggtttataattaaaccttttaacttggttttgtatattttgaataaaatagcgctcctttctagactcctggagaggattacgattcaagtcttcgtccttgacgttaaacttttctctgtacatttctttcttatttgaaatctttattaaccacatcttccttctctcttctttccattttgcgatatcctcctccgttttaagcactattgaagttccaggtatatacagatctgatcctttgacggtttctatgatatcttcatcagcagaagcttcttcttcttcttcatcttcttcttctttccttttatcatcttcatcacttgctattttattctcaactaaagcagaattcctcaaattggtattggcgaactttttgataggacccttcttgggtacttcgattttgtcgtttgcctctaaatttgactgttggtgctctatcacctcttcctcttcttcttcttcctcatcatcataattgatcttgcttgattttgtaacatccacgtatggcggttgcgcttgattaaaaccataccagctctgttgatactggtgcggattcggatagaaaggatggtgggtcccatatctcattcccattggtgcatgctgcatagcggggacaccgtattggttgggttgattcatctgaggtatcggataatactgcattcgcgtggtttgtaacgtatgttgcaaaagattattattcacagatccgccctgtgaagagttattgtacacgttttgaccattcatgttgctcgaatactcttccctggggcctttcttcccatcatattcattaattgaacagatagagatgagatgagatgagatgagatgagatgaatagataatgaaaagaaatttcctacgttcacatacataatgttctggagaaaggtgttgaagttttaaaccggtaactgatgcttcgtaaaccgtgaaacatattctgaaatatgtaacagtcaaacaggctcataagggtccccgcaagtcattccactggtgctatagcttttacgcagtgtcatctatatcacgtgaccttactgatatacgtcttcttattaccaatcataagagagacggattttgaccaagttaaccactgagagtaatcagaaatctatcccccaatatgtcggcttataagttggtggttatgcggcccctccatgtatgtagttttatacctcttacttccatcagctgtgcagtgggtagtctctcaccaacgggtttaccagtgaaaatcgtattgcagcggtgaatttttcaagcttcgaaaccttgaagacttttaaagctcaacaaaaatgtttaaatgttttcagaaaagatttaaaggtacattgaagaacttcttggtactcgatctgagttattagttggcctctcgttttcccattcattcattgttatccttctttttttagtttggtttacgttaatattaactcagtaaattatacttcggcaacagtttataatccctgaatcatgtcccaaccagtacagagagctgctagtcaatctttgatttccaaatacattaacaaggaaactttaaagtatgtcttcaccacacatttctggggtccagtttcaaacttcggtatcccaattgctgccatctacgatttgaagaaggatccggagatgatttctggacctatgacgctggctctagtgatgtactctggtgtgtttatgagatattccctagctgttaccccaaggaacttcttgttattcggttgtcacgttgtgaatgaaacagcccaacttgtgcaaggttacagatatttaaaccatcattatctaggtggcaagaaagctgacgctactgacgccaatgtcgccaagacagcctagatgcaagagaaaatgtaacctgccgacaaaacaacattctttctcccatggcttagattacactactgtgtaggtctgttatctaagatttaatgctaagtttatttacgtactgtatattatatgtctatatgttcaattacagtttatgaattcatttcgaaatgaaaaataaagtacttctttcgttctttattatcaagagtcgaacaaacctttaggtctgtcagcttgtgtgggacccatgccatcatcttcttcctgtagattgagatcttcttggattgcttgtcttttcaaattatttagataagcagccttgttcatttctctttgatgagattcatctgtaccgacattgttcgattcaattgttcctccccattcgacagttgttctcattctctttactggctcgctaattgacggctcggttgttgtgttcgatggtgttgactgggagccagtgtttgaattgggagtagtgttactattttgtttcccccaccttttaaacctgaattgccttccttcttcgtcttcgtcatcatcatctgctccatcctcatccgttataaatagtgagcgttttgtatgtggatacagcatctgcttactttccggcctttgaagcttatctggtttcactacggtatccttcttgattggtgaaactatcttttctggtgacaggttaaattgggtgacagaatcctctggttcttcgaccctaccctcggtatcagttacctgcactaattccaatacaaccccatcttttgttatttcaaagagaatggggtcaccaggttggcaaaaccagattcttatcatgtcatttgttttccaacaattaagtccatttaagaatactttgaaatctcgtaatttgaacgtaatgctcttcttaatactttgtgatctgcttgaaggtctcgaaccgtcgtttttttctgttgaaaatatgcagtaatgttctagatcatttgcgctacatgtattcgttactgtaactgcttgtttgaggtacccttgacttttcatgttgtacacggcttttgtaaatcctattatggctagagtatgtctcgtcaattccaattttatttcctcgatcacattagacataatagagtcaatgaagtttcttagtattgattgatcaaaacttaagaagttgatttcgtcgttaaccgtcaacggtgtatttttcactgtgctcacaatattgtgttcattggcgatacctctattaaacatatcatgttctaattctgtttgtaaagatttgaaataatccactaaccgaggatctaatgatctgcccttacttttgttgttgtatactgaaaggaatttttgtttatatttcagacttaatatgatctgaacactttccaatggatcaaaattaacttgatattctttagttagcaaagatgctgtcttcattttgattatgagtttgttagctatagtttcagaacaattatcacaattgtcgatagttaacatgtattctttaattgtatcctcttgtttaagtgataatagggaaagatactttgcattcgctttgaaactataaattgtgtgaagaatgtcattacaatcggtgatctgctgcactccagattcaccaaatacaatcttcttcggctcgaagtgatactctgtaaagaacgacttaggaaatcgtaccttggccatggtcgtgtctgttgcattcatggatgatatcaatacaccattttcggtgattgttatgaagacatcagggtttatttgagaaagagttgccaagcatttaccccatatggtctgttcattcgtgctgtttatggaagcacgaaatgacattgcaatggcctgttgtcacaacttccagtcagaatccctttatctggcggtgataaaaaactcttcactagatctaaagttcgtgttttttcttgcaattacgtgatttatctttttacagattaaatatttgaacctatgtctataaagaaatagtgcgaatggattagtgattatattaatctgttattatgattcgtttggagctagagaaattgctggagttgaagctttttcagcgggctctttatattttttcttagtcttttccttcttactgccatctttggttttcttcttctttttctttttaataactatgacttcttctttgtcatcttggatggctgttaaattgtcactaatgtgttgttctgcaagtttattttttagcttttccaactcctcttgatcaacagtgtattcaccgtcgtaatcaatgttatcctttcgactaaaatcaaaagatttgaatttattcgatgtggaaagagttatcgcatctgaatgcccagaagtatttgatttcttcttcccctcctttgtgatagtggatggtggagccactacaatatctgacaaaatttgtacagatggtgacttattagatttcttctttttcgtcgaaattttgatgacgggttcgattgtttttgtttcaccctcatcatcgttatcactcaattctatcaatttcgtttctgcacggtcaattttatcatcattcaaataaaacggattatccaacctctcttgtcttctgcgctcttctaaagcagcaagttcttcttctgtcattgaaatgtctttctctgacgagatatcctgagttacagatccgtcagaacttccagcgcttgcagcagatttaacgctctccttgtcggaataatatgcagcttcatcttcatatagttcttcatttttcattaattcttcgagttcaacagaagataaaaatggagtgtctaaatcgagtgttaacgccttaaccaactgctgttgttgtccgtgtgacattgggccaagttcatactcattgaaaagactaggtaaaacgtcggtaattaatagaggtaacccttccgtttcatcttgcaaagcatcttgacagagttttaacatttcatagaactctacgcttcgttcttgtatatcaaaattcgttgatctgtatttttgttccatgaatgcgattagtgtagaaagaagatctgatatttcagatttggttctaccctctgtgttagcataggttgagaataatttcactaatgcaggaatcattgtctgtatcacggtgtctggaagtttattggctttgtttaggagtatgccaacgagagtgtcacagttatcaattaactcggaatattccccaaagcaccatattccttcctttagtaggttaggaagcttggcgataatatcatcgtttgtagtcaatttgattaattgttctaaagccgcatccctcatgcttggaactttgaccataatgtttctaaagttatcacctaacaaagttgatacctctaaattattcaaatcttgtgaaactatacagagatccgtcaatattttcaagtaccagtcgaagtcaccattgatattctcgtaatcatttatacaacagacatctaagacagtcttggcaactttcactttatagtttaaaggaatgtctatttgaacaccttgatcattgacatgcactgtatccacatccacaaattgcttgattagaattctaactaaatttttgatgttgtcagttgatgctataccagagcataattccaatactttggttctgatcgatatatccacatctttcaacaagcctatcaccaatttatcatattgcataatgaattcgaagttaatcttaccaatatgatagaacaacacacaactgatgtatctcaagtttggatcaagtgattggacaagcgattccaaatggttcaaacactgatgtgcggtatcatagtcatcttcttccagcatttgaccctttacaatacagttgatcgattcataaatcacagaaatggcagtagttttatccatcaattctaaaacttttggtaggatcttataccgtagttttggttcttctttcgagagactggtgaaaagtttcaacaatctgatgatgatccaattgttgtcaatttgtataagcatctcgtatagaagaggagaaaactgtataaatggacccgggttatgtttcgctagctcacagataacactcacggcagcagagacaaccgaagtatcctcatcctcaagtgttgaaacaaatttgctgaggccgtctctcaaggattcgggatactgtaagaacactttgaatagggcagtcaccgctttttttctaacatatggcttaccactgtttaacattagaaacaaatcatcgcaaatatctctagcaagttcgggcgttactattgtggaaagaccgcttaacgcgacgcccatcttaactgtttcgttgcttaaatcatatttcaaatctttcttcaaaagattggtagcaagcattagaatatcactatctttgtaaaagctttgagatgctgccaaatacccgactctcttttgctggaaattgttactgctcataacctccaaaacgtggaagttggcccacgccatatcaaaaccgtacatctccaaatatgttagtttcaaaacagcatttgtcttcatgttaaaatctggagatttcacttcctccctgcattctacaatggcttggtttaagaagtcttggagttgctcgggcgtctcgttgttagatctgatcccttttatcaaatcctttaaagatttctcaaaaaagatgccaaagggtcttagccgcttcttcacgtcttcagcggatgtaccataaatactactcatatttctcgatacagcttgtactgttaacaattgactaacggcctcgattgactcttttgctcacttgttaattgatcaagctttcactttgaagcatttcgtacataggatcaatttctgattttttcagctttcctttattttactgcaaagagaagccttagaggtctgaagccaactttgacatttaggtcagatcaactaaagatagacctaatgcaatatatacaattgtaaggaatcaaaagcatttaggtttaatttggtacagtgtaatggatgagcatcgatcaaggacaccaagtatagatagtaggaattatgctattccagaagcggattacctcccggcaggcattgacatagatagaaacggtgtgtctgaatcagatgattcttccgatgatgatgctcaaagttcactatttccaacagaatccagtggtacgttgtggatgaaccaaatccaagatacgcctatgtttgactcaagtaaatttctatttgagtcggtaaataatgcaataaacgatattgacttttcggaatcccttgcaatacaagcaaagacatctgcattgattaattcgaagagccgggagttgaaaggccttattaagcaattacaggagaaagtagattactataatgaaaggtttaagcgcggagctgttgtatcaagccaattgaaggttaacctacagatgctttcgaaacggattgcaactttggatgacctcttctccaaacagtttcctatcgaatataatcagtcgaaggaaaaggtgatggaacgaacattaaatgattgattattgaaaaatatatatacataccttgtgttttttattggaaaagccattattaagtttgttgttaaagagagcagttatcctactctccacacttcgactccaactatgtgaaatttggaaccttctctgcttaagatatcattaccgaatgtcatgcttgggaacgttactcctctgaacaagccgtcgtctatccatagaccataatgtccatcgccagctcccatggacaaaaatgtgcttgtgcagtagatagagaattcgttttccccggtgtaaggaaatcccctcaattgccaattatgactatcttgtttacaatcatgcttgtcatgcaattgtaggtcaggaactttttccattttccatagaaaacattctccgttgccataatatcttcgactatcggtaggatgaaatgtttcattggcatatccaccaaatattcctcccttacgatcccgtatcactatgacatatcctacccttgcattattatttgtatcatacttcaacttgtcgtacaacgaatgtagggatgctccatgttgttctaaactataaaggagagtccattctgtatataactgaattcgtgttggcatcagctggcgtaactcttcgcacatttccttgctgagaagtctgttttttgtcttttcggagtatccaatcaagtgtactggtggtagcgcatcgtcttcttcgtaatggttgtgctgaatggatcgactggttttctcgctactttcatcaccaatgctgtccgaaagcacagttccaagtcctttaccccaactctgtattctgttacgaaaaccactcattactgttcattgagtctgataatgggcggtgtatatcaccaattcgttacttcaggtattcgagatgatttgcttacaagaacagaatgtgtgttaaggttccctaagattaatttttgaatctcatcataaaaagtgcacgtattgaacagtcacgtgcagtagtgtaagcgatatgtttacaacagctccacggcaagcagaacattcacgtcgtatatgactggaacggtatggtataatttaggtatatctatatgtttgataatgcaatatgagtgataaactgtaaaaatgtataaatatttgttaatgaatactccagaacatgtttattcttgcttccttttttcattgacatttgcagcaagcacatgcttattagtatgaaattctgtatccgtagcttccttcttcattgttttggcacattccagcatagtgtgggcttgctgggcaatttgttgaagatgagaaatgacgacatcatttccagcagcaaacccatagatcgaatatttgatgccaactttatcacagaattttatcactagtgattgtgcgtctctcaaattatgtcttggtagccttgggaaaaggtgatgaattacctggaattgcaaaccaccatggaagaaatcaagccatctagggcaatctacatccattgatgttctcaactgtctcatggggaagctttcagtgactccaaggtcagatgtagacatcgcaaaatgtgataatgttatttggacgtgcacaatcatggtagcgatgtgtgatatcataacatatttgaaacgttctgcatttgtcggcatttgtttgtaaatgattagataaaagaaccaataattgaaaaaggaaagcccagccagttcgtaatatctgaaccaagcagcttttccccttctgggaccttgacccaagagaacatgcatccaactcaaccgataaaggttgaatctaccaaagcaaagaattgggtagtaaagatagtgttgaattgggacgactttttgggcaaatttatcaaaccaaagaaacttgtcgtaataggtagaataaacattgtggaataaacgtgtgctgaccgcaaagaatggcaaatgctggatatctgggtcgtgtactgggtcattagtcactaaatgatgcacgttatggtttctcttccaccaacccaacgacaatcctccgatccatgaagcaacagtcatgcctatgatattatcgacctgatagttatgtgtgattgaaatatggccggcatcatgagcaatgaaaacaagttgttgccatgcgaatcccaagcaaatggcagatatagcaaaccatttcaacgacaacaagtagaatgagattccaaagagagtaccaattcgcaggaactctttcaaatagcgcacatagttgcattggtacaaaccagcagcagtaatttctccatgcaatttcctgtactctgatgcgatccattcctggttcttaacgtctaacgatgggaaattcgtcaaatcttcgtaaacacgttcgttatcgtagttttctgacacaattgctggatccaccacaattttcttctcatatgcttctttcaaatcaagagatggtacaacgccttgaggtattttcggataaatcttcacctcagcttcacttgccagcctatcatttttaggtatcttagtgtattgattggattcatcgacagatctccacttcgatgtgagattgatgtcataatcaccgatgtcgtccctctcatcaatcttcgaaaacctaccaccttgaatcggaggcagcatattctcccatggataatcaatgcggccaattttccatatcttaaattttgttatggtctgatcgtcatggtatgcattcatctcatcggtcgcatcgcgaccgatcatatgataaatagatttgtcaccgccagggtgaaacttgatccatttatccaggttcaggaccgaatcttcatatattacaatcgtctggcccttagcaatcctatcagcgatatctcgcctgctcaaaactctactcatactgtagtcttttagctcttgacgctttcaagttcaggattcgatgatttgataaatagtatcaacgaaaacaggtggcttagatagttaattttctttccattgggcttgtgtacctgaaacacaatattatatctacttgtactataactatgattgcattgaactgatatgttaaaaccgatatacagctattcttcgtttgcatattgtacgtggctgtttcatagatcaccatatacatatttgaatatttattctatcttacgggcgttatactgtggtgtacttactgaattttccgggtaacaaatatcatgaatattcccctttaaacgaatgagaaccaactgtcacgtgataaaaagtcttttgttcccgatgatgtagtttagaggtttaaagagtcaggcataaaacccttgaaatataaagaactggtatcttgttatgaagccgaatgcaacggtgtgttgagttatattttgtctaaagtttatccaatctgcagcagatctgaacattacccaattactttgtgtttttctatgagggagttttatctatcatctagcatgttggctagtgaaacagggatcgcctatgaagtcagtgacagctacggatcaagaagatatgataataatggcaatagttcttctgaaaggattcagtatgtgatttcgatggctcattcacagggttttgattggaatcaagatttttttgctactagatacgagcaaatgtgtcaagttgtgtatgacggtcatgttgacagcattgaatcggtaattgaagggttaaaatgcgaggaagaggcagttacggaaaaaactagtgaaaacgaagatgaaaatatggatcatgatggcaggcccattactctttcctccaaagacacaaatacacactaccgttactctccgcaggtttatcgaaggatcagtgatgcttttattagaccaagacgtaaatccgacagaagtatatcattttctgctgatagggaacagggaaactttaaacgtacagaagtgaccgttatcgatgtagaatcagaaactctggagaacaaactcctcaaaagccttgtaagatcataatttgtaaatttcgttggcagaatgtctcttttttattagtacatgttcatacaggatatatacgccgccgaaaatgtattaatgggtaagtaacctagaaaggacgtactatgttgcaactagtctagagatttttgactggaggttcattttaattctgttttatccttatagagaattaggaatatgcattatatattgtacaatagtgaaactgtgtgacgagaatttaatcttcatcttcttcgtcgtcttcttcctcatcgttttgatcctccacagtgagcacagtttctgggttgtcgtttttggtatactttctagcgattcttgaacttttccccagagctatggcctcttctcttgctcgttgttgtaaggttttaagctctggttggaaactctttctaacagatctgtttgtgaacacatcccataattttagaccggggctcacaccaccaacaaccatattacctgcaatttcaatatctggtgcgaatgaagtggttaatacatttcctacaccgaaatcacgacttagtaccatgcttggacctttaccaggctttgcgtctaatggacatttccataatttgacaggtttttcacccatagcactggttaacagcatatttggaatatgtctgttgatttcgacagatgaaacacctgcatcatgagccttcaaagtccaaactggcttagattcggcaccatttctaatatcaaaagagtacacgttaccgttatcagtaccgcaaatgaagatgttttcatcagcaaaacggacacattcgatttcctctccggatgaaacgttccagtatttagacatatcgttgtcgttttcgattctcacatcggacaatgcagcacgagaatcgtaaccagcagtcaataacacagaaccgtttgatggatgccattgcgatgctgacacattggtatttgaatggatgttgattaacgaacgagcggcggttgctgtgtttaaatcccataatttgacagtatgatctgctgatgtagaggctaaaactgctctgaactgtttgttatgtgctagagataggatggcatcagtgtgatgtgttgtcacatgtttgcttttgctcttcttcttcttttttgatttagttggtaaggcgatagagttatctgttggttcaccaagaatcatatcagggaaagccttatcaacacaatccaaattccaaatctcaatggcaggatcgaaagtacccactgcagcgaaatttgcaacagtttcatcactgtttgaacctggcttgtaattcaaacattcaacacaaagtgggaaggctggtaacataaggtcgtggtgtacatacaacgaagaatcacgaactaaaccacgcgccacatcaggatcttgttcatcacccttttctgatggaatatccgaatcgtggaacccggcaccatcatcgtacacatatacgtccaagtaagaaacgtcatcttcagttctggtagctaggaccatgttatcagtcggataaacttgtaattcttgcttctcttccacgtcatcctttgattttggaagggaaatataaggatcttcaccttcttcaccctcgtaaaatttgacttcctcggataaacccatgaacatggcatcttgggcgttggcttcatcttctggatcatcgtaatgctctaagtcgaattctttcaaatcgtcatcaactgccaattggtccttcaatgcgttaccattagtagttggctcttccacttcttctgtaacttcttcacctccttcttcagcttcctgagcctcttctaaatcatgtttggcctcatctaaattcaatttggccaactcgttaatcctttccatctcttcatcgttaagttcatatttctcaggaaattcactcgcgaaccctcttggtacccacgaagtagcagacaacatggtgatacttccacttatcaaacaaatacactgattaattggtatataagaacaccctgtatcaatacaaacagcctataaaccataaaccagtcccagttttatcaactacctatctcatctcatctcatctcatctcatctcatgttagaaaattttcgaatcgctaacctcgaaagaaaaaagaaagtagatggattcgacccctgttgaaacagcgcagacggaaaggaataaggtgttaatggcatctacaactgcagttaagccgcaattataaatctcaaacaattaagcccttatgatagttgtcatagcagcttgatgatcttgaatcgaatgttctctatcattaatatgtaattttgtttgcaaaatgtgcgacttgatgacaccgctcaggttaatctgaaaaaaaaaaacgttgagctaggatttgtcaatatgggaaacgacatttgaaacgacttcaaaagaagtacaataggcgatacagcggttgacttttgttagtactgctattgttgccccgatcgaccttaaggtagctgcgaacgcgcgtcttttccgctggaaataatatatcacaatgtctgaagaagataaatctaagaaattggaagagttgttgaaacttttgaaggtccatgatggtgatttgtcgaagttcacctctcaacaacgtaaggatatgaacgagtataagttctggaagactcagccggttactaaatttgatgaagtgatcaagaaagaggggcctattgattccagtaagagaccagaggatattccagacacacccttgccattattgggagatttcgagtggtgtaccgttgacgttaatgacgaaaaacagttggaagacgtatacgtgttattgaatgagaactatgtcgaggacaaagactctaccttcagattcaattattcccgtgatttcttgaattgggggttgaaaccacctggctggaaagaggaatggcaagtcggtgtcagggttaaagaaaccaagagacttgttggttttatcagcgctatcccaaccaacttacaagttagaggtaatgatgtgcgtagtgtcgaaattaacttcttatgtgtgcacaagaagttgagatcaaagagattggcgccaattttaatcaaagaagttaccagaagggtgaataagtacgatatttggcaagccttgcacactggtggtgtggttttgccctcgccagtcagttcatgccgttatgctcatagaccactaaactggtcaaagttatacgacgttgagtttactgctttgccagcaaacgctaccaaaacccaaatgattgctaaatatactttaccaaagactccaatctctaacattaaactaatggaggaaagacacgttgatgaggcctttgaacttttcaataaataccagcaaagatttgaattgagaccaaacttcgataaagaagagttcagacattggatcttgaccagagaagatgttgtatattcctacattattgaaaacgacgagggtaaggtgacagacttcgtctcgttttactccttgccgttcacgatcatcaacaacccattgtacaaggatttgggaattggttatatgttctattatgcttctgatgccgacttcggatacgacagatttagcgcagagggcacagaaagattaagaaagagattgaatctgttgatcaacgatgcatgtattttagctcgtaatttgaaaatggacgtattcaacgctctaacttcccaagataatgcgttgttcttggaagacttgaagttcgggcctggtgacgggttcttaaacttctacttgttcaattatagatgtttcccaatcactggtggtatcaaggaagaccagacctttgacgtggaaaaacgtagtaatgttggtgttgtcttactgtaaataaatgtttaagatatttaaaaaagatatattctgatattgtccgttgaaacatgcaatgtgggtatgtagatttagaatctcaatgtcacatttcattatgaaatgacggcaggtttcagtcacaaattggaagagcatttaaaagcctaatagtcagcttcttagaagaagttgcctcgatgtcccttcaagaaggagatcatcattgaggcattatactcactaaatgataagcctgctctgagagggcatcttaattcattattcagcctcctctctcattactacttgagttttactatgctgggttttaattaaagaaatctgaaattaaaggctgtacctgccggcataagaaaaaaatggtatttagggaaacgttgaggtgatcagtgaacgtaaaggtatataagcagcagtatcttggcgagtatctaccaaccttaattcgactttaatgttaaaaatagcagatctatagcggtaatccaaactgacaatgacaatgaataacagaattattgaaatattagtgacacttttcttcctacgtattgccagtgcagcagttttaggttctctagatgatgatgcacagcaatctgagaaacaaccagaacaagcaacagcctcacaacaaccagaacaggcagcatattcgcaacaagagactactggctcctacgttgctgctgcagttgaaaccgctactacatcggcaacgaccagtaatactaatcacgtgacttcccaagcaagtgtatgggcagagacctcagccagcaatacagtttcagtagacaatacgctggccacgtcaactagaaactacgatgaaccaataactatactcaccaccacaaattccgcaggtgaaacgtatacatctaagatttggtggctcccctcgtcttcccttactgagactggttcgacgacagctactctgtcacaatcggcaagcagcgcttcgtcaacacagacaactgcttacgtaaatagcactaacggaggtgctttcaatatgaacagggacatgaatcagtttggttcatcaagcaacttggtttacctgggtgcagctattgcattgataatatgatagatgctaggcatacattttatagagcagtatatagttcaatattggagaagccaacactttgacatagatcgtatctcttgcaggtagaatcgatgcactttatgcatcgtctcaaccagaaccgttaccagcggttttcaaatattcatcgtaattccggacaatggactcgtttagtcagtgattagggtgacggcttgattgtgtgactgaataagcgaatgcctttttttcggtcttcatgtcggtagaaactgaaaaaaaaaaattcgaaatacggaaaaaagcttgatagtatttataagatggtgataccttagtaactggtgatgaattaaagtctgcttttggattcacacttgtcattaacattctactatttcatattacatttaagcccaccggaactaattgaggtagggagatcagtatcaaggttctggcaactatcatttcaacgttttatcttttaacctttcgattgttccgatggtcctctggcataataattcacatacgtttggaaattcattcgatgctgtcaccatagcattttttaaccgatacccaaacccatatgcctctcatgttttgagtatcgacactctttctagacgtgtcgatgatgatgggagacttatatctattagattgattaaaaagatggggaagcttcccaattgggtgaaaccttttcttggaaagatatctgaatcctggatcattgaacattcagtggtcgataccaagaagggagaaatgctgacttatactaggaatttagatcatacgaagattataaaagtggaagaatatactaggtttgaaaaagacgggaatagcactcaggtgaaatccatggtcaagttcagtagtggatttgggattgggattagaaacagaatcgagagctggtcacatagcaagttcgatgagaatattcagaagagcaggaagggcatgactttcgttttgcaaagactggatctctcgttaaacaaaacttcgagctgaaaacggtttatttggcctattctccttctgctttccagttatttatttgcatttactaccatacaagcatcgaacaacaaacaatatatatactagagacatggactctcaatttacttcgtcgggtttatcttttaacctcccaggacttttatttatatcacaagaagcagagcagatcaaccagtaaaaaaaatgacgagctaaacgttaatcacatatttatcaatataccagggcaagttccttgttagtattatttgatctcattattgtaaatagtctacttgctttgaaactaaatcgtttattacatatttgtatattattacatttgatctgaatctatatttatgactgaaccgagaatgggtcactccctttctctcaagcaaaacttatatcccatccgatatcgtcacaaatatctatccaatcacgttctctaacccccgaggaccctatagattctccttcgtcatccatcttccagacattttgcataatgtcatgtgcacgaaccacattacgacatttgtaagtatcaatgtaccgtatgaatttatcctcaattatggccctatcctgatccaaacaattgatcccacagatgaacatcggaaaacatagcgacgattccaatttagttcccaagacaagatctagctttgatagtagcgttttcgtataaaacactatttcaaaggtattgttttcaaccttcaaaaaattgatctttaaatgtattaacgccgaaagtctgaaaatctcaaaaaggtgttcggatagctccctatagtttatttcgtcgtcattctcttctgtacaatgcgataaaatgtcaagaccattttcatctggcgtgagatttaataactgttggtttagttccaaggcattgaacataatagtcttgaaattctgtgaagacacgttcaatttctctgatttcatttgccttatcagatttgtagtttcacccaatactttgaaaatgggcctattcaacaaatgtagggaatcgacttgtaaattgcaatcagtgaaatttgggtttgaagataataataacgtttcatattggttcatggggaattttgtggtctgtgaacccatgatatcatggtatatgaaattcgctaataaccaatttctggtcatcaagtcgatggcgtcgaactttgaactgttatcatccgtcaataacgaaatcaaattcgaaccaccaatatgttctttaatcaatttggcaccggtttgtagtaaaatctgccatctattaacgtccccttgacatatctctgccccacacaagaccaaaatttgagccaaggaatataaaaatgatgatggcgattgctggtgctgtggttcatataaacattgtagcgactctaatgtgtaattgttggccaactttgagaaacgcgagtctctatctattataagtcgagtggaagcaccaccttcatccagcgctggcacagatttagaaatggaaaggtgatgagcagcccatgcaagaataccatatagaatccccttatgtttatgtgccataggaaggaaacattggagataaaaattttgccttgctggtgcaatacaaatcacctgagctaaatgatcacgataatagttgtaaagatgcagtcccgttgcatccagttccatcattagtggttctgttaaaggatgtgacatgtacggatcaggaaactggactcgttgcaatttcactatatctgtaccttcctcattcagttttccagcattgatgctggaacttgtattcctctgtagatcttgcaaaaagctagttttattatcatctacaagagcaatagccgtagtatgatctatatcttcagagccgtcgtcctgctgagactcttgacttttatctagggcactaaaccctggtgaaagtaatgagcccatatgttgagggtaagatccatcagattcaatctcagtaagtaccatgtccagcatggacgggctcattacaggcaatttaggagacgggtgtaaatgtgaatgggagtgggaatgggagtttgacatagccataccacttgacataaaactattcaaatgaactccgaccgcatccactgccgcagtaaaaggagaatgtccatttaccaaagtcgaagaaccagctgcagaagaagagtctctgctaatagacatcacagcatttaccttgagtttcttcttcttcaattcagtttgtaaccaaactttataagctcttatctgatctttagtcaaattgtccggaaacacacaatccaaactgagccttgcacaatctttacaaattggcctatcctctgaacaccttttcttccgtactttgcaagtaagacatcctttcttcgaatgacgcctacgtttaggctctccttccgaaagatcaacagccatctttttatcgttcgatcaggatatactgaaaactgtgggaaatctatcgattaaacagcaacgtagtgtgcccacctatacactttcgaaccaatcaggggtcggtgctaatggaataaataagtggttttcagttgaagcaaacaagcccgagcagttctgatttactataaaagacgaaccactccgaggctagaggtaaccaaattccaccttacgtctgtctaatgacattcagatttcatttttcacttccttctttctttttcatgctccacttggatactttaacttcaagccatcaaaaagcttttttaatcttcttaaaacaaataatgaacgacgactcaacttcaacaaaagaggtacgagggaccattggaggcagaattcccgtatactagctcatgatgtactgtaacttattctgaatttacatgtagatatcagtgacataagtacgtaaatatatacatgtggtaccgggtgtagaagtaaaacgtacccagtactcggaggtattatacgaacgggttctcgaattccaagcagaaccgcatgtaggaacgcatgcctcatatttaggaacaacacattagggtttgaacaccattctctacgttggaatgcattgatcaaaaatgcatgagtctgggtaacgcgtcaaggtacaagcttgttacccggattcataccggctgacgtaatgtatatcattcacgtgatcgatgattacctccctgttcttcttcttgtcaccagcacttctcacccaccttcgtcccgctgccagcaaattcgagcaacctcgatatgattggtccgattagatcgaaactgacttggcccctaaactcggagagtggggaacccaaatcctttctcttatctatacgaccgggtaacgtaatgtcactttgcctgcttacaccatcagcaacgcactgtagcccctcctccccttatcaatcccaagtatgcctttttgttttttcttctgcggtgttttctgaaaaaaatacgtttgggtctgaaaactacgccattttcaagctcgaaaagagctattcaaagcacgttattcagcagtcatctttatttgactatcggttcatcccgtgaaagctggattccatctagtgcagtcccaatcccagtctgagtctccgctttgttatcagaatcgattcgccaattctcattgggagaagaggagcacagcaaatttagaaaccctcaagagatttctcgcttactcttcctttctttacttcatttttgactagtgttttcgaatgaattttttttttttggtatggtgattttatcggtatcaaatacttaatatatttcttaatattacattttatcataataaatgaaattaatgtgctacttactgcctgacattttccctatatataagagaatgtaaatttgagaatatcaaaagtaactgactgtttagtcccgttcatttctagatgttgttcagttttttttggtaagatctgtgaaccagcaatagaacagcatttacttgtcagtactaaaatatcatatccttatttttttggattttagttgcttgtaatgatttcttctgggaaatatgatcctttagaagaatcgtacgatggcggttgttctttagatgaaagacctttatcaaagaaagcacatgtttataagtcctgggctaatgtcataccggacaaacagggtctatatgaccctgaatttgagaaagacgcctgcggtgttggttttgtagctaacatcaaaggtgtgtcatcccataagatcgtttctgatgcgcggttcttactctgtaacatgacacacagaggagctgtttcctcagatgggaacggtgatggtgcagggatcttgaccggtatcccacatgagtttatgcagagagagttcaaattggatgtagggatcgatattccagatcaatctcagtacgcggtagggaacgttttcttcaagaaagattctcccgaagcgttggtaaattccaagagaacgtttgaacaattggctgattctttggacttgaaagttctaggttggagagttgtaccacatgattcttccattcttggtgctgtcgcactgtcccgagaaccagaaattttgcaacctttagtagtgttgaaagaattattttccgagtcatcttcatcttcttccatctctaaggatgaattccaatccacatgcgaaaccaagtttaagactagcttgtacattcttcggaaacaggcttctacatcgatcggtcttcaaaactggttttatgtttgttccttggataacaaaactatagtttacaaaggacagcttaccccatcacaggtgtacaattactaccatgatttaactaatgctcatttcaaatcgcatatggcactagtgcattctcgtttttcaacaaatacattcccatcatgggaccgtgctcaacctctacgttggttggctcataacggtgaaattaatactttgagaggtaataagaattggatgagagccagagaaggtgttatggcttctgaggtgtttggtgaacaattggataaattgtacccgattgtggaagaaggtggttctgattctgccgcattggataacgttctggagcttttgatgatgaacggtgttctttcccttccagaagctattatactgatggtcccagaagcctatcacaaggacatggactcggatttgaaggcgtggttcgattgggcgtcatgccttatggaaccatgggatggtccagctttgctaaccttcactgatggtcgcttcactggtgccactttggacaggaacggtttaagaccatgccgttactatattacatccgatgaccgtgtcatttgtggttcagaagtcggtgttattcctgtggagaattcattggtcattcagaagggtaagttgaaaccaggtgatatgttgctagttgatacggaatctggagaaatggtcgacacaaagcaattaaagcataagttcgccaagagaaaggatttcaagtcgtggttatcaaaagttattaaagtggaagatgtgttagagaagacttccaaattcttaccgccaagtttcatttcagattataacttgaaagctcaaactgatccaaggctattggcattaggatacacatatgaacaggtttcgatgatccttgtaccaatggcgcttggaggtaaggaagctctaggatccatgggtaatgatgctccattggcttgtctaaatgaagacccagtactattatatgattatttcagagagcttttcgcccaggtgacaaaccctccaattgatccaattcgtgaggccaacgtcatgtccttggaatgtttcgtaggacctcaagggaaccttttggaaatgcatccttctcaatgcgatcgtttagttttaaaatcgccaattttacattgggacgaatttgaagccttgaaaaatattgaaaaggcacatcctacttggtctacttcgaacatagacattactttccctaaagaagaaggtctattaggctacacggctaccattgacagaatcacacaggaagccagtgatgctattgatcaaggaaagaagattttgttcattagcgacagactgttatctgcggatcgggtctcaatctcttcgttgatcgctattggtgccattcatcaccatcttgttcgcaacaaacagcgttctcaggtggctttgatcttggaaactggtgaagctcgcgaggtgcatcatttctgtgttctattaggttatggttgtgatggtattttcccttacctagccatggagaccttggtcagaatgaatcatgaaggattagtccgaaatgtcaacaacgatgattcatcaattgacgataagactttattagataattacaaacacgcggttgatggtggtatcttcaaagttatgtcaaagatgggtatctctactcttgcatcttacaaaggtgcccagatctttgaagctttaggcattgataattcggtcgttgatctatgttttgctggtactgcctctagaatcaaaggtgttacatttgaatacttggcacaagattcgttctctatgcatgaacgcgggttcccatctagattaacgatacaaaaatcggtaaatttgcctgagtccggtgaatatcattggagagatggtggctacaagcatatcaatgatcctactgccattgctgccctacaggactccgtgagaaacaaaaacgaagatgcatgggaaatgtacgttaagaaagaaatggaggctatcaaagactgtactctaagaggtctcttggaattggattattctgattcggaatcaatcccattggaacaagttgaaccttggacggagatcgcaagaagatttgctactggtgctatgtcgtatgggtcaatttccatggaagctcactccacattagcagttgcaatgaaccgtttaggtgccaagagtaactgtggtgaaggtggtgaagatccagagagatctattgtaaactccaacggtgacaccatgagatctgccatcaagcaagtcgcatctgcgaggttcggtgtaacatcattctatttatcagatgctgacgaaattcaaattaagatagctcaaggtgctaagccaggtgaaggtggtgaattacctgctcacaaggtttccaaagaaattgccaaaactagacattctacgccttatgtgggtttgatttctccacctcctcaccatgacatttattccatagaagatttgaagcagttaatctatgatttgaagtgctctaatccaagagcaggcatctcagttaaattagtctctgaagtcggtgttggtattgtggcctctggtgtcgctaaagccaaagctgatcatattttagtatctggtcatgatggtggtacaggtgcatccagatggaccggtatcaagtatgctggtttaccatgggaacttggtttagctgaaacacaccaaacattagttttgaatgatttgagaggaaacgtcgttgttcaaactgatggtcaattgagaacaggattcgatattgctgttgcaattttattaggtgccgaatctttcactttggcgaccgttcctttgattgctatgggctgtattatgttgagaaaatgtcatttgaacgcatgtgcagttggtattgccactcaagaccccgttttgagagacaaattcaaaggtcaacctgaacatgtcatcaacttcttctattatttgatccaagatttgagaaggataatggcaaagttgggcttcagaactgttgacgaaatggtgggacactctgagaagttgagaaaaagagacaacgtcaagaccaaagcgttgaatattgacttatctccaatcttgactcctgcccacttgatcagaccaggagttgcaacaaagtttaccaaaaagcaggatcacaagttacacactagactcgacaataagttaatcgacgaagctgaaattactctagataagggtttgccagttaccattgatgccaacatcatcaacactgatcgtgctttggggtcaacactgtcatacagagtctctaaaaggttcggtgaaaatggtctacctcaggatacggtggtggttaatatatctggttcagctggtcagtcattcggtgcattcctaactgctggtttgaccttcattttagatggtgatgccaacgattatgtaggaaagggtttgtctggtggtagattagtcatcagaccaccaaaggactccagatttaagtctgatgagaatgttatcgtcggtaatacctgtttctacggtgcaacgtctggttatgcattcatttctggttgtgctggtgaacgttttgccgttcgtaactctggtgctactgttgttgtggagagaatcaaaggtaacaatgcctttgaatatatgactggtggtagggctgttgttctttctcaaatggaatctcttaacgctttctctggtgcaactggtggtattgcttattgtttgacatcagattatgatgatttcgttggtaaaatcaatcatgacaccgttgaaatgcaaagtttagttgatcctgttgaaatagcgtttgtgaagaacttgatccaagaacattacaactataccaaatctgatcttgctaaaaagattctgaataaatttaatcattacttgaataatttcgtaaaggttatacctacggactacaagaaggttcttgagaatgaagcaaaggaaaaggttaaagcggagaaacaatctactgctgatttcttgaagaagttcaacagctcaacggattccgctgttgatgcaactaacggagaagtcgatctgctcagatcatctgtatctcataaatcgactttggctgaacctaaggtacttgatcttgaggatgccgtacaggatactaataatttgaaaaaagccgaggaaaagttggagaaaattcgtggtttcatgaagtataaaatgaaacacgaaaagtacagatctcccgcggcaagaactaaagactggaaagagctttctaatgcaatcacaaagaaggacgctagacaacagactgctagatgtatggactgtggtgttccattctgtacatcagatacgggatgtccaatttccaatattatcccaaaattcaatgagcttgtgttcaaaaaccaatggaaattagcattggacaaactattggaaactaacaatttccctgaatttactggtagagtttgtcccgctccatgtcaaggttcttgtaccttggctatcattgacgatccagtcggcatcaagtctgttgaaagattgattatcgataacgctttcaaagaaggatggattaaaccttgtccacctgaagtcagaacaggtaagattgttgccgttatcggctctggccctgcaggtatggcttgcgcagaccaattgaacagagctggtcattcagtagttgtttacgagagggctgatcgttgcggtggtttgttgatgtacggtattccaaatatgaaattggacaagtcaattgttcaaagacgtttggatctattagcagccgaaggtgttcaattcatcacaaacactgaggttggtaaagatatctccgttgaggaattgaaatctaagttcgatgctattgtttacaccgttggctcgaccattcctagagacttgagaattcctggtcgtgaattgaaaaacatcgactttgcaatgactttgctaaagagcaacacgcaagctttattagacagagacttagaaacaattaagaaacaaatcaaggggaagaaagttattgttattggtggtggtgataccggtaatgattgtttaggtacttctgtcagacatggcgctgcgtcagttctaaactttgagttgttaccacaaccacctaacgaacgttctaaggacaatccttggcctcaatggccacgtatcatgagaattgattacgggcatgcggaagtgaaagaacattacggaagagatcctcgtgagtactgcatcttatccaaggagtttattggaaatgaaaatggtgaagtgaaagccattaaaaccgttcgtgtcgaatggaagaaatctcaatctggtgtttggcaaatggtagatgtaccaggttctgaacaaatatttgaagctgacatcgttctattatccatgggtttcgtcggccctgaagtaatcgaagaccctacctttgtcaaatccaaaagaggtaccatcactacgttgtcagattcctcgtactctgttgacggagacaaggtatttgcagcaggtgactgtaggagaggtcaatctctaatcgtgtgggctatccaagagggaagaaagtgtgctacagccattgacacattcttgatggggtccacaaacttacctggaaatggtggtattgtcaaacgtgactacaaactcttggaagaactagcctccacaatttaaactatttattatttttaatacgagtatgtacgactagtaaagaaacaattatttattaattttctttatatgaatgagatttgattgagagataaaaatcaatattatgaattacttatatattaaaaatgccttattaaatagagggaagaaaggctatgcagtattatatgtacaattacatctgtttcaagttgtcagggtctgtgtcccaatgttcatgaagacagaagaagtatcttttgattactttttaaagttcatttcgttacgttaataaaaaaggagaagggaagaagaaggaggactatatagtctcattatgcaagtgtgagggatgaaaagataggaaggagaagagctgatcggtggcgattcacttgaaaagactcttcaatttggagaagaacccactctttgatgatttttcgtccacgtgactcgatccgttgtctccagtggaggaattcttagagcccttctcatcccttttctttcttgacgatttagggcttagtatgttcccagcaccacctctaccgatcgatatggtctttggaggttccgagaagcgtctcgacttgatctttttgatggttcctgtattgtttgaagaagtcacgtctatcacgtcgtcatcgtcaacatcctgtgcggtgcgtgtcataaccgggtccacattcctcctcatattaccagcaccaccgcgacccgtagagtaaattggcgatagtatattgggggtctgggaaccctgtgtcacaaccttcggtgaaggtttctcgttcgacgttatcatgtttcctgcgcctcctcttccagtacttactctatattcacccatgccgatatattgaataatctcccaaagatactttctttattattgcgttgccaaacaactattccagattaggtccacttgtcacgagcctatatcacaatggttagattggaccaacaactattaaatggatgcacattttatgttttcaatactgacatgtatatataaaaaaggttcggatcgagagttgatcattaattgtgtgttggtcaaggaatcgatgataagggaccgaaggtcgtatgggatgatgaggagcctggtgcatgagtgacgccagaaaaagtaactatttaattttgagaaataggtatcaaaaataaattaattttggagcgtcataatgggcagaacaggatatgaatacgtcaattgggtaccattaaaagggaagtgatcattaacatgttatatggtgccagtggaactctggatagacaaaaaatcgtggtctatagcagggtattttcgttctacatgcaatatgatggtttgacgtagcagtctttgcggcagaagggagggacggaggaaggaagaccactgccccgggtaacagctcccaaaagacccaaaaatcgaaatttaatgccacccataagcatcttgacaagaatttgtaacgaggacaatcaataaacacttgctttcagcagctctaccctaaccgagatcaattatcaatcaacaatgtcctgggacgacgaagattttgcagtgccaagtggctccaaagagaagccagtgttgaattcatgggatgatgagttcgctgaaaacgacgatgagccggtactagagtcctgggaggacgaggagactgctaaacctaagcctaaggcagcagcagcagctgcagccaaggctccaaagaaagcctctccatcaccagctgctacaccagctgctacaaagaacaccatgctcgatatcgatactcttgacgacaagacccgtaaagaactattgagaaaggctgaactggaatctgatttgaacaacgctgcagaccttttcggcggtcttggcgtcgcagaagaacatccaagagcccgcgccgaacgtgaaagagaacagcttgcagctgtcgcccaacctgctgcgttgaccaaggataccccaatccaatcgcacccattgttctcggatttggaaaccaaaaaagattaccaagaattaaggaaagcgttggctaccgcaatcacctcgacaagcaacaaatccttgttgaactactctggtggactagccatcgacttgatcagagacatttccaaaccaatgaccgtcgaaaacatcagacaaaccattgcgacattgaacgtattgatgaaggataaagaaagagaagaaagacaagctcgtttggccaaagtcaagggaggcaccgccacaggcggtgccggtaagaagaaggccaaggctactagggctaacctcggcggtgccttcaagaaggataacgatttcgacctaggtggtaacgataactttgacgatttcggagaagacgatttcatgtaatagaaaaaaaaaacagatctcatcacatatcatcatcacatatcatatatagaacgtaaacaattgaactgttaatattgcccaagtcttgttcgctagcccggtcgctctttctctctctcatctaccgaatctgagagcgctcttgactctccactggcccagtgctgcctcaaaccagtacaacaagatccgatccacgctacatcccacgctacgaagtgaaaaatcatcatggaaatccggcaacaaagaaaagccagagaagaccagaggagagcaagccggatatgtatcaaaacaagggtggatgaaccaagtcgtggagtcgacggtatatgattgttcctattccgcgtttgaactgtttttttttttctcagctatgaacttgtacttatatatatatatatatatatatgtataatcgaacgccgtctgtattccgcatatcaatatactatataataaggtaacaacttggtagagaaacttggtaacttagcagctgttttgtgtacttgttatcgcaaagtgcaagaaagaccagaaacgcaactcaatgttcaggtttgttggaagatccggttttgctttgcgtggttcgctgcaactacgtaaggacgttctgcgttctaggaccactgccgttgcaaaaagacattattcgtcttctaacggtaataacggcggtggattttcgtccgccattttaagcgttcttggtggttctttaattggtggtgggtttgttgcatatgctctaggctctcagttcgagaaggaaaagtccgtgagtgatttgtccattgctagattggaagaccttgattctcccgagtactgtgataaggaaacttttgctaaagctcttgttgaattgaaagatgtcttagaaaacgatcctgaaaacttcactgtggctaaggacgatttggatgctcattcggatacctatttcaactctcatcatgctgaagctaatcaaagaccagaaattgttttgtatccacgcaacacagaagatgtttccaaattattgaaaatctgtcacaaatactctatcccagtgatcccattttcaggtggtacctctttggaagggcatttcctaccaactagaccagggtcttgtgtcgtcttggatatttcaaaatatttgaataagattattcaattgaataaagaggatttggatgttgtggtacaaggtggtgttccatgggaagaattgaacgaatatttgaacgatcatggtttgttgttcggttgtgaccctggtccaggtgctcaaatcgccggttgcattgctaattcttgttctggtaccaacgcttatcgttatggtaccatgaaggaaaacgttgttaatattactatgtgtatggctgatggtactattgttaagaccaagagaagacctagaaaatcgtctgctggttacaatttgaacgggttaattattggtagtgaaggtactttgggtatcgttactgaagctactattaaatgtcatgttagatctacttttgaaactgtcgctgtcgttccgttcccaactgtcagtgatgctgcatcttgttcctctcatttgattcaagccggtattcaattgaatgctatggaattgttggatgataacatgatgaaaatcatcaaccaaagtggtgctacttcaaaggataactgggtcgaatctccaactttgttcttcaagattggtggtagatctgaacagattattcaagaagtcattaaagaagtggaaaaaattgcttctcaacacaacaataccaaatttgaatttgctactgatgaagattccaagctagaactatgggaagctagaaaagttgctctttggtcaaccattgataccggcagaaagaccaacccagatgccaacatttggacaaccgatgttgctgttccaatctcgaaattcgcagatgttattaatgctaccaaggaagaaatgaacgcatctggtttattaacctctttggttggtcatgctggtgatggtaacttccatgcattcatcatctacaacactgaacaaagaaaaacagctgaaactattgttgaaaatatggtcaagagagccattgatgctgaaggtacttgtaccggtgaacacggtgtcggtatcggtaagagagactacttgttggaagaagttggtgaagacactgttgcagttatgagaaagttgaagctcgctttggatcctaagagaatcttgaatccagataagatcttcaagattgatccaaacgatcatcaacattaatctgaccctcggttctatcattaatgaatgaatgacgctaatgaaaatggtaatactaactaatgttataccagatacgacgacgaactcttccctaaaaacaacaaaaatagactataaggtaaattccctgtaattattacgctcaatccatacaaactgccagtcattattgttaatcatattcaaaataaaacaccataactttggtatttaagagcagcactactagtcatcattaacctcacgttcctctacatcaaaggtgcaaatggactgtctgatcaaaaactgacgcaagtcagaaattaggttcggcaagatttatagccgcaatgtactcatacgtaagaaactagaaaactctataaagcctaaaaaaacctgagatataaacattaaccaagttaagaaccagcacatttctaatcatgtgactaacgagttagatgagatccgattcattgttcaccattcattatattattcactgaactttctgcggattgtctaaaacgacaacatagtaacacaaattcattcttacaagtttcatagactattccgatggataagttgacaaccgtcctgaatgtctttcaaagtgagactctccaccttctgcagcaaagtgattgctctatttctgttcttttttcctgctctgtatgtctgtctttctcaaacgcaaaatgttgatagcaaaaaaaaacgatactacacggtgtttgacgacagtttgctaattgaagatgctaagaaaatatacgcacatatacatggcagtattcgtggcagttaatattctctgtgggattcaatctgtactggtatttgtgggataggatccccagactcagggagggtttgaatgtgtacttgatataggttatgtaatattatcagcaatcggatcataatgatgagaccccgatgattaaatggatcgatgtccttgggcatttcatggaggttcaaattgcgtcaactcataatgctgctcagaaagaatctgtcgagttctattagggatggaatacgtatttctgctacaaaagcaagttaccatctctccagtactattgtcgatagatattgtaccatttagtagcaaaccttaacatgttgaaaaacagatgatacaaatccagatatatgatacatactagtatgtatatatatatagggcatggtcgaaagaataatgcctcttctaggattagacacctttaaatacaccattatcaaattcagatacgaatcaatcaagcccgtgatcgattaacgcaacgagagagcaacactactatacccacatattcctattttcaaaatgatgatttcaaagactatttacagaggttccagagtcccagctgcctctagattattcacaaattctcctatggctcgttctattcacaattctaacattgattctaaaggtatcaaagaaactttagaagacgttaacaagaaagttggtaaagctgcagctgaaggtattgagaagaccgaagaagcaactcatcacttgggtgaaaatttccaaaatgttgaagaaaaagtgaaagggatattcaatatgacagggcaggatgccaaggaagctgctgacacggcttcaaacaaggccagcgatcttgcagagaaaggtaaggaacacgcccaagccaaaggtagagaggctgctgccaagggtaaggaagccgctgccaagggtaaagaaaaactggaaaatgctgctgacaaactaaacgaataaaaataaggaatgagatgatgataaagtccggaatgtcgatgtcctcttttcccaataaaccaaattacctgatcctttaagcagcagggtgacaataaacgcccttgtgctaatattctagcattccaaatgccgtatctggggttcgagcaatggaataataaatgtgtagtaaccacaaatacatatataacgtgaaacaagagaaaaatacaacgtaattcttcttaatacttagtctgaaactttctgaagctatcacatctttaacttagcatttgtgacccgccatattcaattcttgtccatcaccatgtaatcactgttgattctgtaatagatggtctaccgaggttgaatccgccagttcttcagaagtattcgatttctcagattcaacaggtacgccatttttccttttcttaatcaactcaagatagttgtatggaacgtacccaatatttccttgttttgttctgactttccaccattcagagttatttcctagtggatctttcttggaaatgattgccattagatctcctttctttaagttacattcaattcttggattctcaggaacgaaatcatagatcgctcttgcaaattctaggttattaggatctaagatttgttgtgccatagcgccgccagctattttggctttttggtgctgttgtaatttctgaataaatttgttcaaaaggtacgggaagccgaacacagctgctaaaaacacaatcaatggtttccatgaaattcttctaccctttttcttcgtcagatctgagtccctgaattcttcgataaattgttttgaaagatctgagccctggctctttccgccctctatccctaagcgctttttggaaggcgctactcccatcttaccacctgtaactctgtacaagatcttttttacgaattttatcaaggcaaatataccaaagaatgatcccaaaagctccttcatatattgaaactgttccgcaacggttatcatagtgaaaaaagagttatgggtagccatatatgtagcttctaacatctgggcgaaaccagcaacggctcctataagcccttctattaactggaaagttgcctgtgttgactctgcaatccccgagggtcctccattcataccgttcataccgttcatcccatacattgatccgaaccctcccccatacatcgaccctaaaccaccgccgtacatcgaccctaaaccaccaccatacatagagccataaccacctccgtacatggatccatatccaccacccatggaacccattccatatcctgtacctaaacctccaccatacgccgaaccatatccagacataccatttcgaagagggtttcccccgttcaaagaatccataccctcatttaaaccgttcggtttggatggtaagtcaggctgattaccagatggttgcaacgcactgctattctcagtaaaactggcatcagttcctaaactctcaactccatttttctgctcccagggcttcggtctggaaacacctgccgattgtgacatgactactgatgctctaataaatatgaacttcgatcacagcacttaatagaagccaaaaccgctacaatcgatgtgtattcatcactgtcgttacctgtatttaagctccacgacatgattcaatgttacttttagaatcatcgtcaatctttgaaatatgctttggccgggtaacaagttactatttcctgcgtcgtgacttaaagacaatagtagatatcgtcttttcatcagcaatagacgatatcttttccacgaagaaccgttggatacttgaatgaaaatccttatttccttcttttaaatattttgtatttaaattggttccgaatgacacgcatattatgtatatatgtatccttgttattattgaaagaatgtataaaagttcgaaatgaagcagctgcaatgtgagttgaatgtatctactacaaagctttatcagcagcattggatagttgtaaatattgaatcgaaaatgttgtccgtattatgcttgaaaaaaatttgtaattatcttatgaaaagtccttcttgtgtttgctttcttctaaagaagttaattgtatgcgtaaattgaaaccatgctgtagtctcgttggattaatactccccgataatacctcgccttcgtcacaatctaatgtcgtagtactgttatgagcggtagtgttgtcgggatcgctgatatgtaaactagattcatctggcttactctccgatttggattcagccagcgcgtcgagttgttcaactgttaagtactttaccctgtttttccttgggctcagtctggattccaaagccttctgaattcttctgcatttagctaattctttctctagctcttttatctttccttcaacagcgatctttactagtgcatctgatttgaatggtggtttattcgatatattctcccgtgacctgtctgaattgtgaattatgaagtctgtatttgatattcttggtaattgttgtatatgctgtaataacgagctgctttggaaggtcaaggactcatttgctctcgttaaactattgttgatatcttttaaattctcgttatccaaatgcaatttatcgttatccagtttcaactcatcaatcttcagttgaagtttcttgattgtcagatctagtctttctttgtcgaaatgatgatcgtcaggatattggaaatcatctttattattcagccacagctgttcgtcattcatgaaatttgatagtatactatttcttttgttattgacagccccattgttatcatttaatccattttgtacctcctcatcagctagcatttgaagttcaagatcaagtgttacagtcggtgaacttgaagtatatgaatctgaggatgggaacctatcacctatttttggaggttctagctcaacgtattttgtggtattacttaactgggatgtactagacattcctcttctatgcccaagagcaggtttgccattggacccacgatttaagttatcatttccattggcattcatttttgtgccaactattggaacattttttatcacttgattactgttgttgttcttcaaaaggtattctttcttgtacatcttaggcggttgcactttcacaggaccaggtattggagatatcctaattggagaagtagatcttagcattgatgaaataggagtgggattggtatctcctccaattgagttcgacctagacctagaccttggacctatcggtatcacgtttgccatactattattgtaatccagttgcttgtccataatttttgacaaagatgtcctaagtcgtttggggtaggcaccgttatcgtctagataaatcgatgagccatgagcaatcattgtatcatcaatgccacctccgagcatcttctttttgtttctgttttatattggatgaagtttgcactcccgtacgctattgtgcctatctctaatttgcggtttactgtgctctaagttagacctctagaggtaaactttgcaaaaagcttcttgttaagagaaattttacagtaggggatactctttttgtctctttattccaaccctaaatgaatctcaacttgttttgctgaatgatgttatgaaaggctgatgctccactgacacaagggttcgactataaagctagcaagtattcggtgctttcctcactttgtcaagtttcaaataccctttaccttccccaacagaatattaacggaatgtaacttcgcacaaaactccttttccaacaacgcaggtgctctctttgagaaaaggaagtgccttttgtcgaccagttttcctctcttaccagtaggatgtcaaaactctccgccaagagactttacgagtgatttcgatgaaggcagagaataactaaacttaagaaaatcacctcgtataacaatagttgaaatacttttgttaagctcaaagaaaaaaatccttaaaatgggtaggatccaaaactcacaacttcatctaccctctttctcttccgtttgtgggaactgtgttaccgaatccgactgctcatcgctttcgacatgtttaagtaaagaaaacagacaatgtttacaaattacccttttaggacataacgttactaaaatcagcagatcggctaagaagtatagacaggtcggataagtcaaggtataaaatgccggggttcgagtcttgagtgggaactgactttcaatgggatcttgtttcaagaactttatgaaagtatatagatatctatatatatatatatatgggactgaaatattactagtatatcagaggtattaatgtacaatggtttttaccggaaagaattgaaagtcgcatctactagtactcttggtataattaaatataatctgttcgtttgttactatcctagtacttcaaaaacttctggtaaaccatattgtcagtttcatcttgatatttatatcctagatcgtccaagaacttttggaagatttcgttgtcttgtggaggcacactgataccagccaaaattttcccaatatcagcgccatggtttctgtaatggaataaagtcaagttccaggaaacgttcaatcctgataagaatttagttagtgcacctggtctctctgggaattcgaatgcaatgactttctcattttcaattttagaagcaccaccgaccaaatatctaccgtgagacttggccatttcgttgtcagagatatctacggcttcgaaacctaaagcatgcaattgttgaaccacttgcttgatttccttttcacggtcaacgacgttaaaagatgtgtagatacaagcggttggtacatcggagtcattttcgtgacaatgctcgttataacggtatgagaattcagtgacagctcttggatggatcacattctgtagcttcttgaaagaacctggagtatctggaatggtgaccaacataaacacttctttaccttcacccaatacagcacgttctgagacgaatcttaaacggtcgaaattcatgttggcaccggaaagaattggaacgtatgtcttcttagaatggtctatttcagggtgtagttgagagacatattttttcaaaccggcaacagcaagagcaccacttggttcgacaattgatcttgtgtcctcaaacacatctttaacggcagcacagatttcatcggtgttcaccaagataacttcatcgactacgtcttgacaaacacggaatgtttcttcaccgattaacctcacagaggtaccatcagcgaacgttccaacacttggcaatggggtacgtttaccgttctttaatgaaacatctaacgtagcggcatcgtaagtttccacaccaataaccttgatatgaggtgcgattctcttcaagtatgaaccaatacctgaaatcaaaccaccaccacctacggcacagaacactgctccgatgttagacccattttgtacttgtcttagaatctccatggcaatagtaccttgaccagcgataacgtaaggatgatcaaatggtggaatatctgtcataccacgttcttcagctaacctcgcacattccaatttggcttcatcgaagtcgtcaccgtatagaaccacttgggcacctaatctcgacacgttttgatatttgattgatggtgttgaaacaggcatcacaatggtagctggaatgttcatatgattacttgaaaaggcaacaccttgtgcgtgattaccagcagagcacgcaataacaccagcattcttctgtgtttcgtctagcttggcaatcatgttataagcaccacgcagcttgaaggaaaacactggcaacaaatcctctcttttcaatttaacgttagtgtttagtctagaggacaatgacaccgcacgtgaaatgggggtctcttcaatgacttcataaacagaagaccttaaaattaaacgcacgtagtctggagatccatcttccaatcgttcgtcagccttcaaatgggagtacatcctctgcaaattatcagagaactggtccgtgctaacacagcgaacagaaagttttaatgcatttgaagcacgaagaactctaggagttctcactatagattgtagcatcacaaaattagctcactataggggcggtataccagattactggatgaactggtttgataccctttcaatgcaaatcatcccacatacaccaatggtcttgcaaatgactctatttttctatttaataccaaagatctgtttaggccattttttcacggtgaaaagattcagtactatctatgttgatcacgtggacccataaaatgaacatccaagatacgtatgcctgtcgctactttacgagttttgatgctgctaaaggagtctagttgaatatccattaacagactattagatcgaattaaacaatagcttacgctttgtgtgattgtattgttctttcagcagttttagctctttttgacattactcaatatctccagaattgtattgtgatctgaagagaaatttagctataagatgagctgcatgatatttacaatcaaaacagccacaatatatacagcgtcattataacttagcattgatttgatgtagtattgtatcactacaaggctatagacaactgagcggttccagtcactcatccgtttactatgctatttaggaggttcttgttcactccgagcaagataacgaatgatattttacaactaccaacacatgaacttttacaacaattaggttacgttaagcaagcctcatctggggtattgcactggctacccttggggcttaagactttgagaaatattgagggaataattagacgccgtatggacgaaagtggggcacatgaagtctcattatcctcgctgtcacaacggtctctttgggaaacgactggcagatggtctaatactgaattgttcaaacttaaggatgcgaaaaagaaggattactgtcttgtaccaacttgtgaggaagaaattacgtggctgatgaacagttatctaaccagctataaagatctaccaataatagcttatcaaatcacaagaaagtatagagacgagctaaggccaagaggtggactattgcgtggacgtgaattcttgatgaaagatgcatacagtttccatttgaattcagaagatgctgtctccacatttgagcgagttaatgcgacttatgataaaatattcactgacattggtgttccttttgtaagtgctgttgctgactcaggtgatattggaggtgatctatcgaaggagtatcacttcattcacgaatctggagaagatactttgttccgttgcaattcttgtgaggcggtatctaatatagagaaatgtggatcatacccggtggagagcaaagaatatctcggagatgtttctgtcaaatatgcgttaaatgaggaaaatgatacacttgtgtgtttgtattatccagccagccgtcatttgaattggaatcttgcccttgaagcagtggataacgatctagagccacaaactagatatatgactaatgaagaagttcttgctaagtttaccgaaaactatgatccgatgttcaacggaatcattagagtgatggatgttcgtctaaattcaagatcaaacttcccagatttcccattgaaatcgtacttaaagaataattttgcgcagctcaatgattattcaatcgttgatgtcgaagaaggtgaaatttgtgcccagtgcgaggaaggtgaattagagagcgccaagagtatcgaggtgggccacactttctatctaggtaaaaaatacagtaaagcgttgaatgctacctttcgtcaacaggacaattctgatgtggttatggaaatgggatgctacggaattggtgttagtagattgatcggtgccatagcacaagtgacaagagatcctaaagggttaagatggccaagttctgtgagtccatataaagtctctgtttgtgcaagcgataaatccgtagaccaactgaacaaagtgaaagcacttcttgattacaaaccttatactgacttcgatgcaaagacaagtattggtgccaagattcaacagtcacatgccttaggtatcccaatcgccatagttgtgggtccaaagagttggcccaacgtcgaaatcgaggtaagaggtaatttcagatccaaaaactgggaaacaagttacgagaaattacatagccaattgggctgggaatacaatcaagaatcagggaaacattttgtgttgcatgaaaatgccaacgatgtggtgaacattttattgaaagatttgtaacaacactaatttactactgtaggcattcctttttttatttattgagccattcatcaatactcgactcaagaagtaatattcgcccagcactcctagtgtcgaatttgggatctcttgaatacgatgagattaatattatattatactttattatatctgaaaatgagttatagaagaagagaagcgcgtcatccataaaaatgatgaaccaaaaaaaaaaatttagattaccacattcaatacccttgtatataaaaagtgaatagtagcatgtgacttgactttgcaagcagaattcaactcaatataacacctttgcgggtttatttacctttcaatgacaacgaaatattactgtttcatccctaaaagcaatatgttgttggattcatgacaaacaaaggtgatgaacaaacaggactaagtttcttgagggtgaatttccaatggagtaaaacgcacataaactctctcgatatatatacaattgtcaatattcttttaagtatattgagtgtaattcatgctttttaaaagatcttaccagagaccttagcaacgacgtgcaaagcaacaacagagaacacaaatgcaacagccaagaacaaaaccaccaatgggtcaactctcaacccattggcttcatctgtgtaaagcttcaaaatagagctggaagaaccaccaaatccagcctgtcttggagaagctggtgtttggttagccttcttttccttttgcaattgagcatttcttctcttttgaagagttctttgaccacctggaaccgagctatccattgttgtatttatatttgttactttcaaagctcactgaatggaataaacaaggctattggacaattaaaccctacattcacccatatatgaatataacaactattagatcaagactttcatgatgcgctgttagcttttcgagattctctgagtttttcatgaactgaatgtagttcgctattcgttgatagtgacagaagataaccgggtaaattagttcgaaagaatgaagtcacgtgtacgtggggcataaactggcctttgcttggggataaagtctgataagtatgtactgcgtcttattctgggggattgtcatgatgcgtctggacagagtaatgtacttcaaaatggagagttgtcagactcaagaccctgattcttcaggagtgataattttaccatttgcattatttcatccgtgctatccactcaaacctacagaccaagcttaaggcttcgtcatcacctgtcgatacctatatatgtaagtattagtggactcttctatatggtatgcacaacaccatccatcatcaggaatatcaatttaataccctattggaaatcctcgcatattattgcctcaattgcatatgaaaggtgtttccctttcgaatcttatcagtgccggtacaaaatatacaacaatgggaaatcacgctttcagcttagtttatttatactcaataaaaaccctacgcagaagcacaccttatgtataaatttacaaaaacatttcaaaagggatcgcctcccgcattgcagctctctcatgttctaaagcacaaccttggttccaacctcgaaatgtgtcacctcccaccaatcttattcgatgtaaacccagtactggcagctttttcaaattttgcagtttctaggcagaaagaaattttaagaaaagttttaaaaatgagaaaacacgatatatgttttttgttttgcgagaactgaacaaagggggtcgaaaggctgagtccttaacagctgatatcagaactatctggaagtaaaattttgcgtacaagtattacaagtattgactttttacttatatcagtggaaagattcagtttttcaggtaaatttcccgcttttatcaggaaaaagtgagacattacaataagcatttgtttctaaaatagacgtgttgcacctgctgttcatcggttttttaagagctacgaaacgcatatcaatttttttgtcgtcccatctaataccttctttaaggcctgtgctgtgtgcataacttgcattcttacgatttaccgtttcccgttaactgactctgcggttttagaacaattttactcaaagaactatacgattcatttagctaatgtcagacgatcagattcaagattccagcgtagagaatgaggagttctccaactcttctccaaattcaaataatgtttctgccaatattgctgaagaacttatccctaccgctattgtgattaaaaacatcccttttgccatcaagaaggaacaacttttggaagttatcgccaagatggatctaccactgccttatgctttcaactaccattttgataacggtgtgtttagagggttggcctttgcgaacttcactactacggaagaaactacaacggttgttcaaagcttgaacggcaaggagatcggtggaaggaaattaagagtggaatacaagaagatgttgccacaagcagaaagggagcgtatcgaacgtgaaaagcgtgagaagcgagggcaattggaagaacaacacagatcgatgagcaatatctcgttgcaatccctaggtgccacgccttcctcggcaccaccaggtggcccttcaatggcctcgaacaactcctcttctcagttgttcaactcattcatgaatgcagactctgcagctcctggttctgtctcaatgggcactgttcctccaagtcctcaaccgtctattcaccatcatcattcccaactttctgctcaaaacactgcagcatctatgtcaatgctgtcaatgcaagggcttcctcaaatgtccgagagattctatgctccattaccagcagctgccaacctcgtgttgccacctcagcagctagatttcaatgaccctgacacacttgagatttacagtcagttgcttttgttcaaagatagagaaaagagatattacgaattggcttaccctatcggtgtatcagccaatcacaaaagggttattaacgtactatgttcattcttgggtcttattgaagtctatgatccaagttttataataatcagacgtaagagcctggaccatgccactttacaaacccatctgcaacaacaaggccaaatggacatgatgcaacctttacaaccttcatcaaccggtggttccatttccagatctcaatcttacaccagtttactccaagcacatgcatcgatgagtcatggaatactttcacaacccaacgcttctaaaaacttgggaaacttacaaggcacatctactcaatcagctggacctgtatctaatgcttctactacagctactacgggcagtaactccactgcaaaccaaccaccatccccaggtcaacctttaatgcagacatcttcctctcttcatcaggataatggtgctagtttgaggaaccaagtcacaacaccatccataatgcagaacagaataccatctggtttccaaacaaatactcagcaacacatgacttcttctagtctgttaaggaaccagggtatttctcccccgcaacaacagattggcataaatcaatctaacactgtgcgggttccttctttataccagtcacaaccaggcacaccaggcatcaacgaaaacagatttgcgcaattaacttctgctcaattgcaacagcaacaatctcaacaacaacaacaacctctagcaccgcagcatacttcagagtccattcattccaactacagtgttcattctatccacgactatgttcctggttctaacaaccaaggttaccaatcgggctctatatcagctagtggtgacatgctggatgatggtttgaccagaagtttaagtggattggatctaggaaagagacatggaacttcggctactaacagtaataatctatggagctgagtttttctactgttttacctgtctcgactttacttaatacactctcacaacttccgtaaacacccttaatgttaccaaagtttaaagcgatgacaataatgattacgataattaatatgaagcctccccctctaaaaaataaaaatcacttgacgataacggacggtaatacccaaattattaccacacactataaacttaatactgttatacacatacacattgactccgatctatctttcgttccactcctcccaattttccttattacatgaactgttcttaaacaacccaaaacctgagtcaatttcttctcgcaatctgattcaatgtaactactatccatccttcaccttctttcaaaagtcgatgagtaacgaacactaattaatgtacttgtacgatctatataatctttactaatctatcacacactatttgatatgctatttggcacttggctaaatgtaaatacgtttcaaacaagagaagcggatgatttatgaggcaagaataggcacgagtgcatttggctgctggagaaaaagataaacgccgccacatcgaaacatcatacagataactcatcatatggaggagtaccaaggtctggcagtttccgttaatacgactgaaacaatggtgaactgttcgaagctctctgtggacgaagaagaaaagaaaaccagaaagaatttcggtgcattcaaaccaagctatgcaagaaatgtggtgtttctagtggaaaagccaattttctttgctgacaaagaaacgcagcatttacgtgtttactggcagttcctgaaatacgcccttttcttttatcactcgaggtgcaactggaaatgcaatttcagtttgccgttcagcaataggaagattccatacaaattcgtaaaaactttactgaaaaaaagaaaaagcctggctctgattaataatcgctatgaagctcaataatcatgtttcgaatgtcaagttctctgaagagcaaacaagtgtccagtttaacggcgtgtatggttgttcgtaattacgtatgagggcgtggctgtactttggtttctccaaatggtggtctagtagctacatagaaacaaatattatccttactaaagtaacagaacagaacagaataatgatggtttacaaatccaatctttcatataacgaactaaaggagaaaactgggagcatacagtagttagtacatagcaacacgcacacacactcgcatatatacacttctctgtctcaactgatcgattgtcgaaaaagtataaaagaagcacggtcaccacactctttcagaaaagttccctcggacaataatcctctcatcggatcaaactatccatctctataccaaacaaacatcaacaggtaaaagcagaaacataaccaataggaaaaataaaaagaagcaatgtcgtacccagataattttgaaggttttgcagtagtcgatagccacaaaaaatggttaagtccagaaaaggttgtataccctgccaagcaatttaatccaagagatgttgacattgaaattgaggcatgtggtgtttgcggtagtgatgttcactgtgccaagggtaattggggtgaaatgaagttgccgttggttgttgggcatgaaatcattggtaaagtggttagacttggtgataagtgtgataccggtttgaaggttggtgaccgtgttggtgttggtgcacaagtcagtgcttgtttggactgtaaccgttgtaacaatgacaacgaacaatactgtccaaaattcgttaccacttactctcaaccatactttgaagatggttatgttggtcaaggtggttacgcatctcacatcagagtccacgaacatttcgtgattccaatcccagaatctttagaaaccaacaatgttgcaccattgctatgtggtggtgccactgtgtattctccattgaagagaaatggatgtggcccaggtaagaaagtcggtatcgttggtatcggaggtattggtcacatgggtattctattagccaaagccatgggtgccgaagtgtacgccatctctagatcccatgccaaggaggaaacatccaagcaattgggtgcagaccattacattgccactgaagatgaaggttgggaaaccaagtatttcgatacattggatttcatggttctatgtggtaactcattgtcggccgttgatttcggcaagctaccaaagattttgaaagctcaaggtgttattgcatccatttctgtccctgatcagcatgaagccatacatttacatccagcgcaacttctaggattccagattactcaatcttgtctagcatctcgtgcagaaatcattgaaatgttgaacttggtggctgaaaagaagatcaaactatgggttgaaacggttccaatcagtgaggaaaatatctccacagtgttcaaaagaatggaaagcggtgatgttcgtttcagattcacactaactgactttgataaacagtttgaccaattcaaagccaagaaataggcgttgaactgtataaattatatagatggttgacacgttgttcatagcttaagtcacttatatatacatactatgacataaacgtcaaaatggaaacacacataaaatacaacctacaatttatacacattgcaaggaacggctttcataaacaccagaggacggtaagggtacagtaaagtgcatgaaatgcagtcactgtagccaaggttacctttccagtaaccgaaaatttctcgaagaagagcaacaagatcatgggaaatatttgctaactgagctggtatgaaagatacaaaaaaatacagatatcacgtgaccatcaagaaaccgaaatttttgatgcagcagtaacatggatctgtattgttttgcttcatttcataggagaaagaatgatataggcaaccggtttttgtaaatgtaagacctagattgcttgctgttagtttcgtttactataactcggactttgtgagttcttgtgagaatgtgtttttagaatagacattcttctcttctaaaactagtaaaggtactatcctctctatttgtttaccttatattgaaagaagaaataataattcatcaagtggcagtcatcgcatatttaagaatgacgacttctaagcgaaatagactgctgaaggaacttctgattgatgataatatacattccaaagtacaggctgatttatgggacgctggagatggtggagtacgacggaaacgcaccagagatagacatgacaagtcgtcggatcatataggctataacggtgctgatgattctggggtgcaaccggagaagaataaggacaagaaacttaaaacgattgttataccatctgattggaatgagatgaacagccatgtgcaattttcagacgatcgtagaattattactatcaggtataatccgttgaagttgcttgatttcaatcaagtgttgaacagaggcagcgatctcgacgtaaaagtaccgtcaattccgctaaatggcattgactttgagatatatgaaactgaaaatttgttaacatctcttgataacgatgctcagttcccttatcgtggcgcaattgaaaataagcaggattatacaactcataggaccattcctcgtgtcaaagatagagagttttttctaactttgctgcgtaagtcccaaacagcagctcgtttcaatggtaacacactcctggcatttccaaatgatgaagctcataatcaagataagaaacggttaaagccaacagctttgatgcattctgcgaagacaaccaacgtggaatatgtttatttccaaaattatgagatcaaaacttggtataaggctccctaccctgaagagtataacaagaacgaaattatctatatttgcgacaagtgtttgaaatatatgagttcaaagtatgtctattataggcatcagttgaaatgtgattatatccacccgccaggaaaccaaatttatagagatatggaccaagggttcgccatttgggaagtagacggaagagagaacgttatttattgtcagaatttatgtttactagcgaaactttttttaaattcgaaaactttgtattatgacgtggaaccctttatgttttacaccataacagtatgggaggacgaagaatggaaatttgttggatatttttctaaggaaaagctaaactcaactggttataacctaagttgtattcttactttaccacattttcaaaggcgcggtatcggacatctactgatggacttttcatatctcttatcaagaagggaatttaaactaggcactcccgagaaacctttgagtgatcttggtttggtatcttatcgaatatactggaaaaataagatggtgcaaacgcttaatatgttatttgaagaactgggtgattcattcgcttgtaccatagacgacttgtccaatctaaccggtatgaatcattcggatgtgatattcggcctggaacagattggatgtctatacaaatacaacgatgaagcctcaggtaaatgcaaatatgcagtgaaagtagaagattgggatatcttgtgtcagttatttgaacagtctagagcgaaaatgaaatatactttggacccttccagatttgtttggaagcatgtcattttcggtccttcgtgtggaatcaatgccgttggaaccatggtagaaacaaatgttagccagcaaagaattacgtctgccgctggttcaacagctgctgatccattcaaacaaagtatatctgttctaacgaattttatgagtgacgatttggcggatccaagaacgatggaagaagctgcaatggaaaagattaagcaacaaactattcctgtatccttgtctgataaatctttagttcgagcatatacacttccaagcaatatcaaggaaaaaatcattaaggcaagcaaaataaaacctgaattcaaacaactcaatacgaagctcggggggactattccagctctcaatgaaggtacaccttctggcgatgcttctgatgccaaaacactgatcagcggaggtatgcacgatgatataaatggcgatgagcaagaaattgaggaagagtttgaagaggcagacggtttagaagatgaaggtttctcgctagatgatgcagaagctgaggagtattcagatgatgatgaagatgatgatcaagtgccaccgcctccagaggaaatagcgactcctagggtcagtagatctctaagaaaactcagacagcacaatcccgtagaaaatgaagttcagcaaagaccacagagagtcttacggaatagagtttgaatattaattaaaggataacctaatcatagtaatgcgtggccatgacatgtgtttatgagaagaaaactgataatagtgtaatatctaatatatgcatgtatatatgtatatgattgtaagaatagcgaaaattaatgccatcattgatatagcagtaaaatgtaaataacaaaacaacgtaatagtacgcacttttcatttaagtgtttatgcaaaaggagcagcccgtgtccctttgctataataaactgaatagggacattattatgacaaaaaataaccatatggtacagttcaaatgatttggcataaagataacactgtaacagtattattgatgttctattgtagttatagtacttgtacaatggggtcataatcaggaaagtgtgtgcgtttatgtgatagtaaatcaacgacaatgatgattgaagtagcagcgactggcgccacgatacacttcggggttcatgttcatacatgtctgaaagtggtttgtaaagtagttttttaagtttttggttcttgataatggtattaatacagacagtttatcatcaaacaatgtgcttgaatatcgtattcaaactaggcagtggctgagttggcacttgcggtagtcgatggttttgtggtggttgaggagattgcgatgaattcggagtgaactggggcgtttgttcattactagcctgtgtttgaagaatttgcttcggtacgctggcaggcatcctattgccataaaaagatgagttgttcacatcagaaatagttggagaatggtctctcaaggaatgagcgtccggtgaaaacactggcgatctctcacgagcggaagaaccagtcgaagatgtttgagaaaacgtaggagattcatctcttagctgagttggggcaatagagtcttccatgcggccaacaatctctacatcaacatcaacatcgtcaatgtcgtcatgctcctctacggcagtatctggtgagtaagtagagtggacctcatctgaagaactcgattgattaacattggcggaaggactagcagtactaactgcatcgctaggcgttatatgtaacgaatccattctccattggatctcttgttctgatctatgaggtaacaagattgaaagctcatcaatggacaagtggtacctttgacgtttttctaccaacaacttatcctcatcgccagaccaaggttttgcaaagccattgaatgatccaacggcacatacggatgaaggagggggttgagagctttgttttatgggcatatcaatgaaacctgcttgcatagactcacgtctaaactgagagacagagttccttctagacatagatggattcgtcgtgaagctttctctccttggattcgcggaagatgcgggcaaagttgatgaaggcatgacaacaacggaagatcttctagaagatccgttagaagacattgggatgaaatgcctgtcggatgctacgttgaaagaggaacgtctggagcgcgaggagaaggaatttttccttgatttcgtactggccaggtttggcaagttcgattgtggagtgttattcacaacgaccgcggaaccacgtctactcttgatgaagacttttggaataaaaccaaaattttcctcttgatcattgaaatggggcatatttggtggggcgtcctgtgaatgagaggaagacctgggctttataaatttcccatgaggagcaggagaagcagtagagaacggagacttggacaacgatccggaatgtgcaagtccgtttaccgataggacactagatccagctgtagcagcagatgacgaaaaaacacccatgttgctattgttattattagtagcactcccactaccattcaacccatgaggtgacgaaagaacggcactattggtaacttttgaggtcggaattggcatgggcatgggcatcggtcccgtagaactagacttctttgccgtattcttcttcgccgtcgaagaggacccagtgtttaaagattccgcgctcaacgtaggtcctgcagaaacagccattggagcaagtactggaacagtcacatttaacaactcatcctcctcctcatcctcctcctctggcgacttcaccgtctttaaactgccagattttaaccttctccaccgaaattggcacgcgttaggagttctattcgtaaaatactgagcaatatccttccatcccagtcttttcacctctttcaagtgtcgcaacaagacatcgtcctgaggttcccacgaactcggagtcctactggaaacgttttttggtgcagtcatctaccctttcacttaaaaatattgtgagttataattgtaaagtatcagcaaccaaaacaaaatccactatttagagcagtaaaaccaaaattcagctcaaaaattttcgaaatgtaatcaaaacgacagtaacagctttctaatagctctaattctctagctcaaagacctgttctcattaacacaacgagagggaataaaaattttgaacggtccaaaataaaaccgacagtagtttatgaacgatttttctttttaaacaacaaaaaatcgccttaaattccttccaaaatcggctaacaataaactaacgtattgacagttatgctctgagtcgatatcactgaggtcagactgagtactgaaccaataaagacaggtttctgcctaggaaacaaagagtgtcaagttaaatgacaagactcgatgaggtcgagtttagtggctttttcttcgtcgcgatgagttggaaaaaaaaaaaatttcgaattttttcagtgtgacagcgatgagatgaggtgacaggtgagatgagaagagatgagatgtgatgtgagtatactgagtgagggtcctgtatcttaccgttcacgtgtctttttttgtttttttcgtctgtgtacttcttgcaaatggggttccccggttggtttgggactggtgcgttagtctacgccttcggaaagctattgcagtagtgtgtagaatgtgtcaaaataagcttatgggaggtagggggatgcactccgggaggtgataagtgcgttggtaggccattggataggcttcggaagatacccattacacgatatttttggacatcgtgtggcatgtacggtctgtgaatgtttccatgcggacttgagtcacagagtggagcttaaccttacatccgggtaacactcgaaaattctgtacaagccatctcacgatgcgcaagaggatatgcaactcatcccacttcagaacgataaaaggacttcctgtttgtttggcatattttcggttcattatggccattgtatatcactgtgaaacagcttctacactgtatatgtccagagcacttcagaagatgacaggtttgaaacagataaggtactttgacattgggttcaatatctctgatcacatgttcaaagggaaataccatggcaagaagcagcacgagacggatttatccaatatattgaaccgttgtagattgactaatgtggataagctgctgattaccggatcttcactggaagaatcgagacattccattaagctttgtagtgaatttgcaactgaaaatggaccaaagatgatgtacaccatcggggtgcatccgtgtcaggttaacgaattcatgcccaaacactcaaaatcgtaccggaaatcagattcaagcgaggatcttccgtttgcaattgaaaaccatcagtttaccaaagctagattgcacgaattgtatgatttgtggaaactccaagcaatgaccgataacgagcatttcagggccattggtgaaattgggttggattatgatagattccatttctcgggactggaaatccaaaagttcttcttcctggaacaattgaagttaagttgcttcttccctgataaaccgttgttcttacacatgagaagctgtgctgatgatttcttgcacatcttgaaattattcatcaatggtttcaacgatgataaggatttatttggctataaatcgtggatcgatccaagcgtaccagattcaccaatattgaatacagacggctctgtaacttataagttcagtgctgcgaggaaatttgtcgttcactctttcacaggatcagtacaagatatggaaatattactggattgctcccaaaattgctatttcagcgtcaacggctgttcaatgagatctgaggagagcattgaaatgattaaatcacttcctgttgataaattactactggaaacagacgcaccatggtgcgacgtgagaaggacacatgcttcatacagatttttgaatcaagatgcagatcccaaaatcgaaaattgttgggatcatggattatctgctgcataccccacactagaccaatggttcaaatctgtcaagaaagagaaacttcaaacaatcccacgcgaacaatgggatctgtatatggtgaagtctagaaatgagccttgtacaatggggcatgtggcgacagcagttgctaatatcaaacaaattccattgatcgatctagttgaccaagtatggcatacttcttgtcttgtttacgaagattgaacttgtcgccttcacactctatacttcaaggtttcatcgaacctatattcaatagaaaattaaagcgtgatttattaatgataaaaaagtagaatatacatagagaaaagtgaggttgaaaatagctgatagagatctgaattgcaactgtcaaagtttttacatgatattctgttctatcttagtcattagagtttgtcatgttgtttagattgttgagatatcgttgtattattatttttttttactttaatgaaatatgaaaggttttgctgtataactcgttgcccttccaggggtcccagaattatgtcgtaaggctgtatttctaattgtaacagtaatggcacaacttagtgaataattgattagaattcaaaattggatcgaatatatattatcggaatatatcaggagaatacgagaaatagaaaggaaaagatgatgaaaagataaagatgaacaacattggatgcaaacacgttaaagttgatagtgtgtaatatttttgcaaggaatagtacctgcacagtgattacaactgctcgcttccgtcttgccctttgtatcgagagtggaaaataaaaaaaataaacgcacaaagaatgaaataattaaaaaatgcaaatacgagttcaatcttttttcacttcagattcttcaacttcatcagcatgagttggttcgtctgcttcatcttcttcatcgtcttcatcttcttcttcaatttgtgaccttattccaccacttaacgacgccaaaacttccgataatgcagtaccatggatgtaagataagttgttctcgccaggcgttatctgaattccaccggaaccaagtatggcctctaggttagcgaggctagatgcgcctctgtcagcaccaacttttctatcatcattgtaatcagtttcatcagattctctcttgtttgttacttcaaagacatgatcgtcattttctgggaaatcatagaaatggaacacagctcttctttggttctcgaaggagtttggtggagtgtaattctttgctacgatacgtttatgccaagcagtttcgtcttcgtcttctttcaacaacgctacaatgataatactcatgttatcacaaccgatacccgttccttcagtggttggagaacaacaaacgtcgataatcttggaacttatttcttctagagttaatccttgttttaacccgtaatgcaccaaatcaacacagtcctgggatgttagacaatcccagataccgtcacatgccagtataacaaattcatcactgttgtaatctatggtgtgttcaatcaaatctggtacacaggtaacaatctgttcatggggagccaaatctgggttggatttgaattcaaaatcaccgatggcacgagacaaggccaaattaccattaacacggtccatttccacgaacccatcagcagtgacgattctggaatattcagacttcaacgtaggtttatgatcgtacgataacgccttagcaatatggtttcttgaaagaacagttcttgaatccccagagttagcacaaatcattacattttgtaatttagagattaataaagtcgttgcagtgcatccactatggtcgttcgctaacacgggatccttcaaaagctcttcatctgtcgcaataaaagattgaataagagcctcgttgtaagacttcttcttgaaagcatcctgtttttgtaaaatcttggagaactgtgatccacagaactgagcaacgcttgaaccaccatgtccgtcaaacacacagtagtacgccaaatgctccttctcatcatcagaaatgttcaaatcaacaatgtgagaatcttccatagacatacgccatccttgcatagcacataacccaaaagcagtcaaaacatcactaccagaatgttgttccttatcaattacaggattagacaaaatttgacccattgtttctattaaaaaaaggcttgttattagtctcttcgtccgtcctttcaaccaataaaaaggatgtgtcgactgtattgaaattcttggagaaacaaacttcaattaaacagtacagcagcttattgtaccaccttcttccaaccaattgctatcttgatccgctgatatctttgaggtggcgaaataaacaactcttccttttaatattttcgtttcaaaacaacaaaattgccgaaaacttgtgacaaaggtttcaccaaattcaacatctgagcaatggaaagaagtgatatagcagggaccctacggctttcatctggatttggggggacttatccaatccatactatctgtggactgctaaacagcttgaaattgggatttctagctgatctttggcaatattaggacacagtgtgctgtatctagcgttggaatcaccagatgtccatcacgtgacttcgttctctcggttgtagtctcaattacataaagcttgttctttcccttataaggacggttattgcatcagtgactaagtagctcggtcatatgtatgtactattgaagcattggaattgacagctaacacctgtctgtgtaccatttatcgtgtctctttcacttcattatgactcaatttcatagtatccagactttggacattgaaaaatttaacaagatgagttaaatgacttgtctataaaacagtgagcattgtgaaatatttggagcaacccaccattgcagtcctagatttgagtatatctggttgttatatttaggtaaagaagtgattagagatattcttacagaaatatacactaaaaatggcttctgatcatattactattcagccatcaattgaggtgattaaagaatgcatcgctgctaatgatgattccatcaatatgtacccagtataccacttcatgccagcaatggaccttacacctcatgtggcgtatttgaaaatgagtgagttgaacaataaggagaggtcaccatcttttctatttgaatccgcaaacggtaaccaattgagtcgatactcgttttttggtcatagtccacgtaagattatcaagactggtcctactgaaggtcaagcgtgtgacccattgaatattctacaagacgaattggctcagtatcgattggctgaaaatgttccaggcttacccaagctttctggtggtgctattggttatgtttcttacgactgtgttcagtattttgaaccaaagacgaagagaccattgaaagatgtgctacaagtaccagaatctgctttgatgctatacgataccattgttgcatttgatcatgttttccaaaggttccagatcataactaatatcaatgtgaagacggtctcatctttggaacaaggttacgaagatgcatctgagattatcaaacgcattatcgccatcttgaaggatgaatctagtccgataccattacctgaacaaccatcaatcaaattgaaccagactttcacatcaaacattggtcaagaaggatacgaacagcacgtgagagatttgaaagaacatatcaagaagggtgatatcatccaatgtgttccatctcaacgtgtcgctagaccaacttcacttcacccattcaatatctacaaacacttgcgtactgtgaatccctcgccatacttattctatatcgattatttggatttccaaatcattggtgcttcacctgaattgttatgccaagttgatgccaaaaacgaagttatcactcatcccattgctggtacagtcagaaggggtcagactccagaagaagatgacagattagcggaagagttgagaaattctactaaggacagagcagaacatgtgatgttagttgatctagcccgtaatgatgtgaacagggtctgtgatccaaccaccacttccgtggatgagttactttcagtgcaaaagttctctcacgtccaacatcttgtctctcaagtcagtggtacactaaggaaggatcaaaacagatttgatgctctaaggtctattttccctgcaggaacagtttctggtgctcctaaggtcaaggccatggaattgatcggagaactggaaggtgaaaaacggggtgtttacgctggtgccgttggacactggtcatatgacggaaaatccatggacacatgcattgccttgagaacaatggtttataaagacggtatagcctatttgcaagctggtggtggtatcatatttgattctgacccatatgatgagtacgtagaaacaatgaacaaaatgaaagctaaccacaatactattctacaagcagagcaaatttgggctgagaaagttggcactcaagactagcgctgtatatgtcatatccactaatagttgaacctgaacctttcccgtttcgttcacagtatgtattctatcgtgtattcacattagacttgttatagaattgtaaaaaggtagctttaagtgtaccatggatgcacatatgaatggattaatgccactggataaatatacgaaaggtaggagtaggaatctggtggtctaaagtaccagcagacgtcctacttcatacgtttctatccagcagttgcatataatcttttctttaggaaaattttacattaaaccgatatattccaagtgatgacaaggagatcactggcagagcatattaaagcagaggaaactgacactatcactacagctacatcaaaccataactgctatccagatggcaccatcatcgttgaatttagcagtgttgttcacgctgtcagcattatctctgacaactggatattatcttggacagataacaccatcaaggaaggatgagatacaagaattgttgaaacaagcgaagattaaggctgagcgagatgagcaagcgtatgccagtgaacatgacgatggtgatgaggacgaggatgaagacgaatctgaggatgaagatgaagatgaagatggcattgcagtagattccatatgcctaaatgacattcctggtgaagtaaggatggccttggttatcaggcaagatttgggaatgactaaagggaaaatcgctgctcaatgttgtcatgctgcattagcctgttttaggcttattgcgtgtgatccaagtagaacttcatataatccggagatgactcacagatggttggcaagaggtcaagcaaagattactttaaaatgtccagataaggaaacaatggatgagctcttcgctaaggctattgcattaggagttaactcatacgttgttcatgatgctggtagaacacaaattgcagcgggaagtgctactgttttaggtttgggacctgctccgaaagcagtccttgaccaaattactggtgatctcaagctttactgatacttcgatctctcaaatcgttggaataatcatcgactgcataaacaactctatcctgaaaatataaggatttaggttgtctccgtatatttaaacttgtacatatgtaataatctttgtaaaattatactatatttaagatttatacccatctttggaccaccactgcattgcataggtcttgatctttcaaagtggagtcaaattcgtcaatgggttttacgggaaatgcatggcttagtgtaaatgggcgcatttctgctgtgttagctttaacatgctggtacaagaatctgatggtatctgtagagttacaacgtaacacctccctcttcccagaagcatatctgatctgtacactagtgtctccctttagctcgtcatctggcgatttttctttgatttcagtccctactggagtagattcggcaggcgatgctgattgagagtttactgcatcaccaggaatgggtgagcccaatctcttacctgttccttggaagccactcacttttctcttaggtggaacgtaaggctcttccaactttttatagaccgtgacatcgacctcttgtccgaattcgacgtccaataactgcaaaggagctcttccttggtttagttctttcaaatagaaactattttctgggtcgtcgtaacgatatagtttgccatcaccgacttggaatccatctttccaaaacgtaatttcccttgtcacttttttaggttttgatacgaccggggtatcatcctcaaccactgttggtggagcagaaacatcggatcctagcctataacctttaccaacaaaatgatgtttcttactttctgcttcctcattctcttcttcctcctgttctgctctttcaccgcctctgcgtgccttttgtaaaagatccctaattaaagaattagagtcattagcgtgtgggtcggtgatttcaagtcctgaagtctcaccgccagcaaaagtgttccgatcttcatcttcatcatcacctcctttcaatatatcagagaaggattggaatttagacttagacttgggtttctgcgatggagaaggtgttgacctaggtaaagcaatcttttggccactcaaggttcttgcgtatgtaacgtcatctttcgccgaggagttagacaattcaccctggctagcagcttttggaatcggctgttcaaaggatgctttcgttttaggctcttgctcatcctgttgggtagcatagaaggcattcaatgcttctcccaagtcaccaaactggtttaaataatctgaagcgacattcactgaggtgttggtcaatgcgacaaattgctggatttgttcgtcagacatggtaaatatcgtatgtggtatctcagattctatatcgtgttacaattgtaattgtatcgtcgtaatggagtgcaatatcttgccatgacaagtggcaagttttccttatggcatctctacctaaatgaaattgtcttaatttgaaagttcattacttttcatagaaaaacctttaaaacgaatctgtaagaaaaggaaagtaacatgataaacacagacatcttaggcaggatagtaactgagactgtggggaaatattatgtttgtagcagaaatgttgtggtttgatgttttttttgaaacgaatgttgaatgcgtttataatatacaagaggttatttaattattaaaaacataactcatgacagtttataatttggggacctttaacgattgaatatctttggaatgatgagcaaagatgaagttcgccattaaggtctatgaaataatgtgatgtgatcggaagaaatgggataaataaacagaccaaaaaaaaaaagatgtaaaaggtaaagcccgatgttgaatccgtgaagaacttatatcaaataagatcttcgtttgtattatgtgtcagtttacaataagcaattcattggaaataatagaccacttgaagcattgaaagacacttaaaatgaaataaaagttgttattggttaatgctgattttttattctgttccttaatccaataatgcataatagataaaaagacgcttgagtgttgttacaaactcacgagtctatttatttcttagcgtagatttcacggaagtgcttagcagcgttaaccatgttggtcaaggtagccttggtttcttcccagcctctagtcttcaaaccacagtctgggttaacccagaacttttcagctgggtagtacttcaagaattcttccatcttttgaatgaattcttccttggatggaactcttggagagtggatatcgaacaaacctagaccagagtggtttggatagttagcaaattgcagaatgtagtttggatcgtccttcttggaaaattcgatagaaacgacatcagcatccaaagccttgatatggttagggtccaaatcggagtaacagaagtgagagtggatttgagtcttgttggcaacaacagaggtagcaactctgaaagattcagcagaccagttgtagtattcggttctttcttgaccggctctcaatggcaaaccttctctgacggctggttcatcgacttggatgaccttaataccggcagcttccaaatcagagacttcatctctgatggccaaagccaattggtaagcttgagtcttttggtcaacatcatctcttgggaaagaccatctcaaacaagtgactggaccggtcaacatacccttgacaggtctttgggtaatagattgagcgtagacgacttccttaacggacatagcctttggtctagacaagtcaccgacaataattggtggtctaacgtaacgagaaccgtaagattgcacccaaccgttgacggtgaaggcataaccttccaattgttcaccgaagaattgaaccatatcgtttctttctggttcaccgtggaccaagacatccaagtcaacttcttcttggaatctgatgactctttcaatttcttcgttgatgaattgttcgtattgttcacgagtaatagtacccttgttgaacttgtttctgttgattctgatatccttagtttgtgggaaagaaccgatggtggtggttgggaacaatggcaactttaagatttcttgttgttccttgattctttcaacgaatggagaagatctcttacccatggattcgttgatagaagcaactctagccttgacatcagcattgttggtaatggatgaagtagctctgttgttcaaggacttagcgttagcttcgaattcagcggtaacgtcttcacctgacaacttcttggcgatggtgacaacttcggaaaccttttgagtagcgaaagcgaaccagtccttaatttctgggttcaacttagtttcgttttccaagttaactggagtgtgcaacaaagaggaagaagtggcaaccaagacacggtcactggacaacttagagatagcggattcgacaaattcgacagacttggcgaagttgttcttccagatgtttctaccgtcaacgataccaacggacaaagtttgcttgtcgttcaaaatggagataacatcgttcaattgttcagggtttctaacgaaatcgaaatggaaaccagcaactggcaagttcttcaaagcagccaaatttggaacaacggtaccgaagtaagaagcaacagtgatttctggtagaccttcttgagaagccaagaaagtgtaagctttgttgaaagcagcttggacttcggctggtagatccaaaaccaaagttggttcatccaattgaacggatttagcaccagcatcagccaatttcttcaagatttgaacgtacaatggcaagatcttttctagtaaggaaattggttccaagtcagcggaatccttgtcactcttacccaagtgcaagaaggaaactggaccaacaagaactggtctggtttcaacgcccaattgcttagcttccaaatattcatcaactggcttttgaccgttcaatttgaattcagtagagttagagaaggttggtctgacataatggtagttggagtcaaaccatttaaccatttccaaagctggcacatcaacagcagcagtggtttcggtagcctttctttgcaaacctctagccatagcaaagtaagtgtccaatggagacaattcatacttagagtaacgttgtgggataacgttgaacaatagagaaagatccaagacttgatcgtagaaagagaaatcgttggaagcaatgacattgacaccagcatccttttgcaacttccagttagaggccttgatgtccttagcaacttgttgtaattgttcagcagagaccttaccgttccagtacccttcggtagccttcttcaattctctgtttggcccaattcttgggaaccctaagacgtatgattgaaccattttgttattgacaaactaatgtatgattagtgattggtttgtttggcttaagatattaaactcaaactgaatgataaaggaaataaatctgtatttaaacaaagtacacataattccttttattattgtaatgatgaacaattgtcactcctcaaattacatcaagagtcgactgcttatatacattttttttcagatcctctttggactgaagtttctgatccaacaaacatcgtttaaacgatgagtcttaattaccttcggctgctctagtcgttcccacgaaaaaatctgctcaactacaaaactgccactattactactgctgctactactacttacttttgacttgagctcatcggaacgtaacagaacaaaacttttcaccacaattcaccaaaggattctttctgcagagatggggctctctcagataccatagaaaagcacatgtcgtcaaaataacacttcccacgaatcgcacagcatttcacatgtggtttgcctaatggtttccacatggtttcctgcacggtgttttgacgtaaatagtgtggtataagaccgacgtaggttgggcaaatggtaactgtcacgtgctgtgccgtagtcatggctaaccggtcacggggaatggttcggactgcaatgtggctcaatttggtctgtaagggtgtggttggggcggtggttgtgcttgttgtggcgtttttatgcacttttccaaagcaattttgatccttttttttccacaccatcctcctcctttctttcacatggtgacgatgacttcgtgatacttacccggattgattgaaagagctccaaactgaacagcatttccaagtcacatgtattttcacgtgacctacagaagtagtagactgtctctctcgattggaactctctttcagcagaaatttaagccagcaattatcactcttcttcttaacttcgaacaactatttacgaggtgagacgattttctccagtttcagtgctattaccaccaaacatccaatatgccgactttggaagtagagcacaagaagcttcttaatagaagagaagaattgctgaaacaagacgtttctcttaggaaagattacagtatcttgcttcgcaagattacaagtgtctgccaggtattagaatcattaggtgagcctattcacatcaatttaaatggataccccatcttccaacagccagattatcagaagtttaaagattgggatgctctggtaccacttttgaagagtttagaagaagtgaactcgttgcccttggatgaaatcgagatcccagaagctttacaagaatcttatgaattatttaagatgactccattactatataaggatggttctgaatgaaagtttggcttgtcctgaattatctttttcttctcctctcgttccgtatcatgttctcaacggctcgtgtgttgatgaacagttccaacaaaaattttcgaactgagggtttgaatcggtactctcccaataattcataaacttgttcaaacatttctgggctttggaatctactaggcccatacttggactggagagcagttatctctttgatcgcaccattcagaaggatattgttgcccatatcgcttactatccttaggatcctattgttgatcttgtcatcttcaaacacatctggcagtttcgactcatttgtttgggatatctctcggatcgctcgttccaattcttgtttgtcctcttcctgctggtcgggattcacagacgtctcggatctttcccattccaataagttgtctaaagggatctcatggtccccaactataatgttcgaattcagttcattgttacatatagacgccgcgttctgattgtgttcattcacttcatcccattcaatctgaatgtctcctggtggtattttgataggcccaaggtcagaccaatgcaacaatgtatcggcattttttgggacacatacaccaattggcatacctcgagtgtccattattgattcccagccgacttcttcaagcatttcccgcccctccatggtatatgaaactagtcccaatacgtaaaatgcagtgttcttaatacttgtatattgactttcgttggccaattcaacgatatcctgcacaaatgaatacttatcaagtagattgataccgtaatcggttgcaccaatgaatccacaagcccacatacaacttgtcaatttaattattccttcttcgctatgtggtggatcgttatccgtttgttcattaatgatatgcttcttaatcaccgtgacaaaatcttttatatcatcggatttactcaaaagattggcaccttcctctgacttgcaaaggtattggtaaaagtgtagggggaagctgcgttttgaagtgctttccggctttgatatttcttgctctaggaattgctccactttgaagacgaattccctgtttttgaatgttttccaatttattctttccttattggtatagtttaatcctctcaactgctgaaacccttcacttgtttccataagttttaacaaagttggggaaccgataaatattaactggtctaggcagttttttatagaagattggagaatcttagttggatgtacgttcgtagaacaataatcgtacaatattttatccgcaatggcaacaacggtcggagccaaatcatacaattgcctacaagtcagttgaataaaatacgcctctagtttaacctcatcttcttctaaactctgtaatttctctcctaatgtctctgttgccaaaatcctaatggcttccctatcatctagtagggccttgtttaggaacatcttacatcttgaaaatcggaagttcaattccggaagtgctaacattagatatttgatagaaatgctagatttcttcgaaaacatgttgttgatgacagtgaatacattccatttctcaaggaacgacataccactggaattttctgtgaaaaccccgaaaattatcttaaaataaccactacaaagcttttcgttcaatgcgttctcagtaaatagcatatcactaacaaaatggccttgaatgttgttatatagcacagatgcgatttgaggtatcaacttggtgtcatcagccagaattttggtgccgacgttactagatagtaacatgcggaagaaaagacaacccacttctacataagtgttagccataggatccttcaaagaaacactagtaaatctaaatcgaaaaggacgatagaacaccaacattctacgaacgaatctagtgctttttgctaattcatctagtctctttttgttcatcaatggactcttgcataattctcctattacttgccagttccaaaaactgaaattcttggtttgaagtacttttgaatcaaaaaccatctttttgaaaccaacatcatctatgtttttctttgaagaattcaattgcataactcctgcagatttaagcatcatcttttgtgtgttagttgtagcgagtttacttctggtagaataaacggcattgttgaaaacaaaagtctcatggaatagcttatattggtcaagcttctcaggaaattttaagttattgaactttgttatcactgtcgttaagtgcattgaggcgtcaaagtttttggcaagtataagtctagtattatccctagtgcttgaatctaattttggtaaggctgctagcgaatatttcataatcttgttaacaaaatcagcattgttcatcatggatattaagagataaacgtattggtctatttgtgagcagtcaattttctccggtatgtttcttttaattcgcaaagatatcataaatatgttcataatgtatttgaatagagatggtgattgcgcaaaggcaattaattgctttagtagttggcaatcgttcaaagcgaataaaagtaaaccattaaaatcctgtaatattcgaactatcactctgactgatctttgaactttatctaagctgccagtaagttttgtttgataatctgagaatccgctgagaagatttcctgtatggaagtttttgataaagtagggtcttatttgcggatatgatagcatctcgatcatggaactgatagccaactcctcattttttgtatttggatctagaatgaaagcctgaattattggaaatgcccgacattcgtctattagttctggtttaatgaaggtcaattctataagggtttcaaatgcaacaatccgtagtgcatcatcttgtagctccacgcaacttacaactgcttgtgtaatcgatttatttataccataagcattgaaatcaatgaacctcctagtaagtttgagcgcttgttcgcgttcttcttgatgggctttatctttaccaagggacattgtaataaaaacatctatgtgcaattttgtcataaaatctatagtgttctcattcaatataaggtatcttacaattctgtatccggcagaacgaattttttggttgctattcaacaataaattttgtatcgttgaagcaaatgctgttatgacgagatcttcttttatttctggattcttgtgtagtaagataaccaagccatttgctttctgtaaaatgaagtccactgaagcgttgatatcctgtaagctttgtaaatgatcagatatgagccatgtagcggtttccttcgttggtgattcgtaaagcatgttcatagataaatgctctgaagagtgatccatatcatcagactgaaacaccaacgtcggtatgctttttgttggagttaaccgatgacctatttcctcagattcttgctcatctgaatcactatctcggccttccgaaatactttcattcgattgtgcatttatattttgtatcggcttcgatggtgttattaaatcaccagctccagcctcggaccttttcaatttcagttttgttaactttaactgctcttgcaacctttttatgttgatttctatatctctaatttcactgttggctctaagtctcatcgaatgattctctaaatgattagtggagtatttatccacgtatatgtcattagaattagacgatttctttaatctcgcatggtccactttccgtttcctttgacggtcaatctcttgttctaattgagtaatctcggatttcaacgtattgatcgtagagcttctatgcttggtgagaagcggactagttggaactggtaccccatcatcgaaccttcttgttgaaacaaatgaggtagaaagtacaaggttctgtcttttcggaacatttgatgtcccatttgtattagatcgtgatctatacaggtccgaattgcttctgaatctttccatcaaagcagctctttatatatgtctcaacggaccaaattacctagtcaatactgtagggttttgatgtgatattagggtcagcttactgtacttaccttttgttcttatgtgttatttcgatgatctctatccgaactttagtttcattaagagttaaattataatattctgtaatcacggtagtttaagaagagtaaatcaaaaataaggtaaaaaaaactgctatatacaggacgaaatttcatgtaacgaaatatctcagaatactatttataatatttacattcacgctaaggatttatttcttggtggaaagcattgcttctaatgcatctgcgaccttctgtgtgtcttcgtcaagatccatattagtagaaactaacttgtccttttcagaaccgtctcccataagttccttcaatttatttcccaattccttgagtgtcgaaacgtcccatatccagcatagaccaaaaccaagcattgcaaatccaccagtggataatgcggttccatatgccaaggcattgacaacttcacctttgtatgaaaatgggggaggcttatgattcaattgaaacatagtaggaatatctataaatcagagttaaagttagtaactgaacagtgcaaagaaagagcacgttttgaaatcactcataataacatacatttacgagatgcgacacctttgaacgcaagtctagcagagatcaaagttaaagccgttacaccaaagaagcgcatcatctgcactttccttctctctttatacaaaagagaaaacttctcgatttgagcatctgttacactggctacttctgacatccttcgaaatatagtgcttcgtgtttggtcttagaacacactcagatgctgcattaacctaaaccatacctgttcttgtaagaagtcaattgatattccaatattttaatacttcctataatgttgaacatgaaaaaaaaaaatcaaaatagaactacaatgaacaggtttaaaccacagatttgttccaaaaagatagttaattcgagtagtacttagtgtaaaaggccaagtatagagttcagaccaagtgttcgccatgcacccacaattagaggcagaaagatttcactgtatgtttgatttatgaatgttatgattcatttagtttggttttgagttcaatataacatcgcagtactaacataggatatatcggaaaacagcatgtattgatttaatccaagctttggataaatgtcacaggaaggaatattataagagagcgttgggcctctgtaataatgaaaaggaggctttgtctaagtgtttgcatgaagcaagactttcgggagaaagacgttatattttggaatcaagggaaaagaagaaagtcatcgagcaaaaatggaagaaattggaggaagaagagtatggcgaggatgccatcttgaagaagatcattcagagacaacttgagaagaagagacaagattcccaaccatctgaatgagtattatgttttttacgtaaatcattcaaaatatcttgtaattagccactgaacatccaaaagaaaaaacaatccttcatttctcctagcctgacatctttcctcattgatgtattctcgcaagtaagcctgggtcgacttttcctcctgacctatggtacatttttacagcagtatcctctattgtatatatcgtttttaactcactatttatatactgaatcatcaaagaatgacatttctattataatatacacttattgtaatatattttatagactctaatagtggcgacgacaagagtagtataaaccagttttcaatcttgccttgtcttcaagtatttcttgataactttatccttctttatgatgtacaccacggcaccccaaccagacaatgcatcacggtctgcagcattaagtagagcttgtgatatcgtctcaaatagatcgtcagcttctagatttggttcgtacaaagactcacacataccgaataactggtctgaagcagtaccacttacaatgaaatctttggcttcatcaatacatccgattaggtcaaaccctgcgatgaatggtttccctgatttagaattaataccagctactacgggtcctacgaaatatggaccaaatctcttttcatatagggatgtagataccagttgtgtgaaagtttcaggctcgatcggtctgtcctccctcaacttgtataaattagttttgtaacggaaactttctgaaagcgtaagcacatcagttgctagccctgttaatcctagaaatacgtgtccgtaatggaagattttctcgaaattgttggcgacacctaatgactgcgaaccaagtcttaagtcgcatccaatggcgacacaatctttaccagtcatagcgactacaataccaccgttaatagaacttgggtcagacattttaactcaattatatcttgggtatttttttcactaacaacttgatttccaagtggatcctgttgccttttttactgcacttaatttgttaatagtttaaggttttgccactacatcctaacagatttcaatctttaatattcgtactttacgaggaaacatcatactgtacgtgtttaaaggttacccggaaatggtgataatgttaaccttcttcgataaagtagaataagctgccaaagctgacatccggtaaaagctttagggtgagccgcagatcgactttaaccagtgagagataacttgaactcacgcttcacatatttctatattattttcagttttagtagaccaacattggcgttgaaattagtatttattatattattttacaagatagcccgttcttcaactggatagtggaagcaaaggagacattagatgtattagtattattcttattgattgcgttggtactatttgtctataggaaatttatcggaattctcataacttttttctatagctttgaggtactcgttatgtttatggtactgcctgttcaaatataggtatttagcgttccaattgtccattattagatcaaaattcggattatgcgtccaaatcttgattaacgctggttttatatcattgtgttcgtttatccattctgccaattttgtaacaaaaattttccaatgtagcagctgtgaatccatgtttaatttacctgattcttcgacgttgaagttggtgtacaaggaatccaatccatacaagggttcccagtggaaaactttaatttttgggttcactttgaagctgttagggtcttcttggtactcagacagtattcttccagaccatccatattcttgattagataccatttcaaattgcgaatccggaatgggtgtaatcctactggcccagaaatttatgcaatccacgaaggtttcacattgcttggaagatgaacattcaaatatcagactcttgtgatgctgatcatcggcaaattcaacttggaaacatttcggttttgatgcacccgtatgatcaatgattgtttctccaatgagctccgcaaatgcaccaaatagattaaatctttggataatagaagttccaaaaatgccattcggtccagtcagtgatcttgcagaaagtttgttcttactttttgttaaatgaagttcaagcgatcctttttgaactgttactctagctctgtgcatctttctgttcgcattttccattctttgttgttgatgagttaggttattacctcttctgaaaagtttcattatcccgtgagttgcgctatcgcatggttctgatatagaatgagtagacttgttgaccttaaagtttaaagtgtggtctaccaaccataaagagtcattttgtttaccgaatatatcatcttcatgctgatgaacatagaaatcggttgcatttacgtgttgagaccattctgattgagaagacagtaccgactgtgatgtggtagtcttttccaaaagcgaacttgctggtcttaaagagaaaagcgaagtcttacgggatacgctaaaagacacacgttcattgggagagggattcatggaagaatgattcatagaaggagaatcatttgaggttgaagaataatcattcttgttgctgacttctttgaaagtcctcggttggcacaagggaaatggaatgtccagaatttggttataataaccacgtaaatcatcctttatgagtttctcatctagctgcatatctttcagttcatatctgatagcatagatggtattctcaatgaattgatccactgtaaatttgtagtcgaaagactcattgtgtaaatcagaattgaggatcaacagagagaacaaaatgatgtgacagaccctatagttcccctgaaagtgtgagaccttgtccttatgttcatcggtccattgagcagcaagttcttctaaaatattgtctagcggagtagcttctgcgatcaaataaagaccatgggatagctttgatagagtaagatacaacgaagtcggccaaggtctcaaaaggttcaaaaattccgttagtacgcgcttattctcctttgcacctaaccaattcgcatactgtgtatattccaagggccggtaagtctgtttcagcatctggtcagccgtttgtagatctgcatcgttaataaacgcatggatattcgtcatcttcggagattccactattggtggatcggactgttcattgcctaccatcaatctgttatgattctggttcttattaggagttataaacgcacccatcgatggcaattatggcaattttctgtatgtgattctatccctacactatgtataatcctctgcttaaagccctttgacatacgcaaaacacctttcaattcttctctatccaaggtagaagccaaggttcaagcggtcagcgaagaattcaaggattcccccacaaaaaaatatccgagacagaaaggctgaacttattaataagacgttcttgagaacttggcgatcaaatctatcgctgtttaatagtgcctgatgtaacggttggccattttaaaattccttttaagatttcattttggcaacaatttcgatatttcttttcatattattgcctaattctgatataaaagtaaagccgctaagaaaagccgctaaggaaagacgcagtgagacaaagatcaacatctattgtacatgataacactgcaagtaatatggctttctacaaacatatatggctcactactttatatttatcagtactatgtagaaaagatggaagacagaacaagcaatgcactgcatgtgttacacttaaacctttcgaactcagttccggtgatggtcatgatggggaggaccatgatgagataatctttcttgatccaccacccaccgcaatatgacatgtgactgaagagtcacgtgccatgtaaataaacactcttcagggactgtttaccattttaatttgttttggtttgaaatttgaataaaaaaaacaaaacaccaaaacacgaaaaaggctatataatttaattattaattacattacatgagacatcattaatcaattacgttcacttttcttgggagaagcagttttctatcctagttgtgaaagggtattgtagtggttataaggtcgcttgaaccaggctaaattgactccacagaattagaaatgtcacaggtggaagaagttcagactactcagggccattctcagttgatggtctcacgaaccgaagaacagatggaagatgttcagcaaagaattcaggaaacggattttatggctgaagaagacgatgtggctctagccgcctttgtcccaatagagaaattgcaggtgaacggtatcacttctggtgatatcaagaaactaagagaaagtgggttacacacagcggaggcggtggcatatgcccccagaaaagatttaatggagattaaaggtatatcagaggctaaagctgataagttactcgctgaagcgtcgagactagtgcctatgggttttgtcactgcggctgattttcatttgcgtagaaacgaaatgatctgtttaactactggatcgaaaaatcttgatactctacttggcggagggatagaaaccggatctatcactgaactgtttggtgagtttagaactggtaaatcgcaactttgccatacattggctgtcacatgccagatacctttggatatgggaggcggtgaaggcaagtgtttgtacattgatacggagggtacattcagaccgattaggttggtttcgattgcgcagaggttcggtttggaccctgacgatgctttaaataacgttgcatatgcaagagcttataacgcagaccatcaattgaaattgttggacgcagctgcacagatgatgagtgagtcaagattttcgctgattattgtcgattctattatggcattgtacagaaccgacttctcgggacgtggtgagttaagtgcaagacagatgcaccttgccaagttcatgagatcattacaaagactagctgatcagtttggtgtcgcagcggtagtgacaaatcaggttgtggcccaagttgacggaggaatgatgtttaaccctgatccaaaaaaaccgattggtggtaatatcatggctcattcctccactactcgtcttggattcaagaaggggaaaggtccacagagatactgtaaagtggtagactcaccatgtttgcctgaagcagaatgtgtgtttgcgatctacgaggatggtatcggagatccaagggaagacgatgattgatctgattctctttacctggttattcataacaccaaaaaaaaaagaataaaaagaaaaatccacatttttaatatagcattcaatttcctacgttgctagtaaaaccccactgcgtatctatcttctcatttatttgttcatatcattcgtgttataaatagtccatagggcacgttattctatatgtatattcatgcaaaccctctctagttgttaaatgctcgcataaaacgcatataattccctcagcgaaaagggacgactatcctttcatttaagggacttgcatatcatagctacaaacacttctccatgtcagtgtgctattaataggcttgacttcttttaatattctttacctcatcacaccggaattccgaacgtcaacaatctgaagcgaaatttttggaaatttcaccatttccacatatagacaagaaagagtaattttgcatttctatataaaacacgttaactttgtaaaacaaaggtttgcgagagaacatattctggcaagaaacaggagggacagagcggagaagcgtgctaccgatatattagacttgtcactaggcactctgttatttggggttttaagtacgactcttttttgataatttttttgaccgattctcgtgatataattgataaatcgaacgttacaaatggcagcatcagcctcgcatgtccatccatacgcacagcatttagctgaactgaatcctatggtggttgacatccctgaacttgaagttagtggtaatgtttcttctgctgactttaaagccgatgatgaggaacctagggctttgtccggtttgagctcgcctagttttacagtaaccggagaaaagtacgcgaatttacgttcaaataataacacacctccaaatgagacacctgagtatatcaggaaacataagagatctgaatcgagcaatgggaatatgtctgtgaattctataccttctagcggttctagaggctcagatagacgggtaaagtccgttgtttcttttagttcaaatgcggagaatccgaacagaagatcaagatccgtagatctttcacatttatacctcggtggtgaaagggacatacgattcacgtccacgaatgaacttgtggcagatgagtctcacaagagaattagcacatatttaggtaatgattcggctgcctcgttactatctcgtcagaaaaccatcgaaatgtacaaacaaaatgttaagaaatcgaagaacccggatgtcttgttccagtacagtcagtacatgttacaaactgcattaactatgaaccccaccgaatttgatgacaaaaaaaatgaagacgggttaaccgtggaagagcagagacagcaattcttgaaagaagcattacattatcttaagaaattgagcgttaaaggttacaaagatgcacaatatttactcgcagattcttactctagtggtgtctttgggaaagtgaatcaaaaagaagcattctctcttttccaagcatctgcaaaacatgggcacgtcgaagcagcttatagaacatcggtatgttttgaggaagggataggtactaccagggattctcgtaagtgcatcgaatttttgaagtttgctgcatccagaaaccatccagctgccatgtttaaacttggggtgtacgcattttacgctaagatgggtctttcagacgatctcaatacgaagaagaacggtttgaaatggttgtctcgtgcggctgcaaaagccaacaggttgacttgtgcggctccgtatgagatggcgaagatttatgacactggtttccttgatatcttgattgccgatagaaaatatgctatggaactttacatacaagccgcatcattgggacatacgccatctgcgactcatttggggagaatatacgaagttggtaacgaagtagttccacaggatacacttcttagtgtaaattattatacaattgcatcacacggtggggatccagaggctatgatggggttatgtgcatggtatctaatcggagctaagcctgcgtttgttgccgatgacaatgaagcatttgaatgggcgctgagggcggccaagttaggttatccgaaggctcaattcacagttggatatttctatgaaaaggggaaaggatgtgaaccaaacactgaaaatgctatgaaatggtatcagttagctgctgataacaaggatccgagagccttgaacaaactgaagattaaagatcgttcctcaagaaagtcgaagagtttaagtacatttaatttcaatttcttactggacaacaatgaagaaaagggtaaaagaaaatcgttccatctgaatttggaccaagatgataagccgggaacttttgttgatatggagcaaaatctgacggatccatctaagaaaaataagcggaacaattcgatacccgttgaacaactgcagcatccacaacaagaaaccccaagcacattgtctgcttcactacaaaagcagtctgcgatggaacatcagaataccctgtcagctagtggtcagaagagcttacatgaccaggatgtagaaaagacacctaatttaagatctctttctgaccccaaattggacaagatctccattcctcaaactaaaccagctcttggagaaaatgaaaagaacggcatcgattcaattaagaagaacttaaagagcaagagtaaacgtaagaatggggaaaagaccaagaaaggttgcgtgattatgtgagctaagtagaaatagggaaactatctacaagcaactgcatgtttttctcagtttattcttagaacttatagacctcggccatctcaatgtataaatcattgtatttaaaatctggatatcagtaaaatagttcggaaaatgcatatacatcattattagtatatcttaatggcaaagaaatgacaatggttcatttattcttcaaagcataatatgttcttttcaatgtttaaagtcaactcaaggcaagaaaagattaaacttctagttaaacattgaaagaccaagaggtaaatcttactgtcatcaaggccaaatcacgtgatcgtaaatcttggcctttttttcatgtcttcaattttcagcaaaacatactgcatttaccgtgaaatagatttgtaaagaaacagaaaatcgtccagtatatggggagccacagttaatacattgcaacaacatttacaccatatataaggggaagaagttcttactaacaaagttataccattgatagttctccaactttttaattgaacaactttcatcgattatagcgacatattagacctgccaactcacgtagtcagataaacacacttcaagatgatgttccaacgtgctttgcttcaaacaaagagttctgtattgcgccagcaacctctcagaacttctgttagattcatcagaactttcaagcaagaagaccaaccaagattgagaatcaactctgttgctccaaatttcacagctgatactactgcgggtaaggtcaatttccatgaatacattgggaactcgtgggctgttcttttctctcacccagctgatttcaccccagtgtgcacaactgaattgggtgcctttgccaagttgaagccagaattcgaccaaagaaacgtgaagttgattggtctatctgctgaaggtatagaatcccatcaaaaatggatcaaggacattgaagaagtgtctcaattagacaagttcactttcccaatcatcgctgatgttgacagagaagtatctttcctatacgatatggtcgacgaagaaggtttcaagaatttgaacaatggaatcgttgctaccatcagatccgtatacatcatcgatccatcaaagaagatcagattgattatcacttacccagcctctgtcggtagaaactcctccgaagtgttgagagtcattgacgccttgcaaaagggtgactccaagggtgttgtcactccaattgactggcaaccaggtcaagatgtcatcatcccaccaactgtgtccgatgctgatgcgtccaagaagttcggtgatttcaagactattaaaccatacttgagattcaccaaggcataagttataatttcaaaccgttatgtcccctatatacacttcaattagacatgaggatgaggtaaataaactgtcagaagaagagctgacccagctagaattcggttgcagaccattgcttactcatgattccggagatgttattttatcattatatacgaacaatattctaaccacatacctaaattccggcctgcaaacctgcttaacagaagcactattccaactgtgctgggaacgggactgaagagtcgagaaacctatttgtctcacaaagacactcacaaaaataattgtcctacccgtttggctgctacctttatttagctttttacccttaagaacgccttttctcggacctttgaccttcgagaataatactcacattcatttcaataaagcaattagttattaaattataaagtgatctactccgcacaaaggtacaataagatgtacaattgagatacatggcggaatgtaacagaacgtaaagtaagggtgccggtctcttgaccatgaacgttacaaacgcaaaaaaatgagtcgcatctcttttcagtttttaaaatccgaggcgaatctttctatataacacgggctaaatttcaaggaaagacaggaatgtttttagtctatatatctaggcagaatgggaacagcggcaatctacaacagttagtacagctatcttagcatattgagtatccaccgagggctaccactaagaatcgtggttgtttcaccttatttctgcccacatcgctggaacttcttattttctcctgccagcctttgttgcacactgttttctatatacagtgatacaatcggtattgatattgaaatcgacattgattgtttggctttttttattttttttcggatttaacttgaagaatatctctccagagagaaacagttggtcagctgaaagactgaatcatttatactagtcgattagactatataccgtgtgtccaagttttgttgtcagcgctttaactgccatacctttcttttgtttctgctttgtgcgagattttaattttacattaagttagtaccaaatttttggccaaaaaaaaaataaaattcaaagaaacgatttaaagtagaaaacttgggaaagaagaaaaagctgacgctgggaatataatttgaagaggtttgtttcatcactctacagctgtcattttcattatttttgttgatttccccatacagatactgtttgccaactgttattttgatatttaacttttgttcaactaatacccttttcttccttcaagttgattaaaatttcggttttggcacatttgaatgattagcagtggatatacttcaaaaacgttcaaacaaagctcaaacagatcaggaaatattatcggaagcgactatagatagaatttaacaaggctcgcacttttcatcgtttgcaatcgaaatatcaattctttcataatgggtgatccagtgtcttcaaagaggaaatcctctgtgtccgatgctgtttctacaagtaagaggcaacaccagcaggttaaagtagaagacgtgaatgttccactgtcatcgcgagaacattcaccagggcctcaattgcatacgcaacagagttattatggcaatggtactgacggagcgagcgaaagtgcacttacacagtcacgaaacaataatggggcgacttcagtggttgctatctcggatgctacgcaaaatggggaagatagcagcaatatcagtaataatagtaatgccgtgtcgaaaggtaaagcagttgtcaacgctggtcatagaccggtgacgtcgtgtacgcactgtagacaacacaagatcaaatgtaacgcttcagagaagtttcctgcaccttgttcgagatgtgagagaatggggttgcactgtgagatcgatccacagttcagaccgaagaagggttctcagctacaaagtttgagaaatgacgtcgatgaattgaaagttaagatcgagtatttgaccagaaatgaaagtttgatcgccaaggctctaaaacaaagcaatataggacagaatttgttgcaagctatcaaatctgttgatttttcatacagggtagcagggccgactcagggtcaagtagcgaagaataagatttcagtacaaacctaccttacgaatgaaccacagttactacaagactctcaaaccacaactacaaatccaaccacgtcctcaaattccaaagtggttacacccacaggatctgatcattctcctgccagtcataatggtggcagtctaagcagcggtaaaccgcagttgttgaatgattcagtacctgcaaatactaaagaccgtctccctccagttttgcagatcgctctgaaacgcctaagtcaacaaatttcttccagttcacctcagaatagtagtccaacaactacgggtcattcacctgctaatgatctttcttcaagcaaacaacatgttgttgcaacgactaatgcaatgccgttgttgccatctcctcacgctaatatcgacgagtttgtcttgggtgatgtccacatttctattgaaaaagccactgagttacacaacatttttgtcgccagatttttaccatactttcccataatgcaatcaaattcggcaactgagctatattctcagtcgcagcttctattctggacggtgatattaacagcctcattatcagaccctgaaccaacgttgtacaataaactttcttcactaataaaacaactcgccattgagacttgctggatcagaacgccaagatcaactcacatctcacaagcattgttaatactctgtaactggcctttaccaaaccaaaaggttttggatgattgctcatacagattcgttgggttagcaaaatctctatcatttcaattgggcttacaccgtggtaagttcatgacagagtttaccagaactcaaacatcattgcccgaggccgaaaagtggagaacaagaacatggttaggtatatttttcgctgaacaattgtgggccagtatattaggtctaccaccgacctcacagaccgactacttgattgagaaggcaagactaggtgatgacggtgagctaccgccgattttaagaaagctaatctgtctagctaactttcaaggtaaactctgcaatgtaatgggtacaagtgttgtttctcctgatggcttgatggatgccagggagcgtgccggttctctagctatcttggaaagagagttagaaagacttgacgtaaaattgaagttccaagaggacgctgccgtcgaaatttactttttatacatcaagttaatgatctgctgctttgctttcctcccagagactccaactgaagatcagacgaagtatgtcacagaagcatatttatgtgcaaccaagataatcaccttattgacgaagttacttgaaactcagcaactaatcgagcttccaatttatatcagacacagtgcaacttattctgctctcatattattcaaactatatctaactccacttctcttggacaagtatgtggattccgcccgtcaatctattgtcacggtgcacaggttatacaggaatcaactgacggcttgggccgccagtgttgagaatgacatctctcgtactgctagtgttttggaaaaactcaactttgttttagtcactcatccggaagtattcatagaagaggagggtataatttcaagaatgagatcacatttgacaggtactttattctatgatttggtttggtgcgttcatgaggccagaagaagacagatggatccaaactatgatgctgaagctgctaagcggaacaaagaaaaatggttcaagaacagaagaaagttatatccattgccattttataatcaaatttctaaagaggactttgagactattactcaaactacgcccggtgggactactgttacaacattggttccaactaagagtgctatcaagcaagctaagcagctagcacaatcacaaggagaccaaaatggcccagtcactcatattaatggtattccgttatctatgcttgacgagaccggtagtgtcaacattgaaggattattggccaatgcaaacctcaacctttcaaatgaacacagtactgtattggcttcttcttcttctactgctactaggttaaatgcagataacccaacaactgataccaacaagttcaatgttcaaaccgtgttcactcataatatcaaaaaatcttcaaaaagcagcgatacacctacgaacaaacctaaattcaattcaacttctagcattcccacagctacaccaacttctgagcaacgtgcagctcataataccaaaacttctgcaagcattttgactggtgatccaaactctcttttctctatgaacaattcattgcaagcgaacatccaactcaacaagacgctttcggctgattctaatggaacttccaataacaatattcctaattctacggcacccttgaatacaccagatactaatagttttaatagtttgaccagatcccctgatgccccatcttacggaaacatgaacgtattttacaatgctgcaaaccagggtaccaatatgaataccttatattcacaatcggtacccaatgcacctcagggtatatcagctccgctatcagctcaaccggtcaatgtcacaaatatacctaacgggaacgtcaactcggaacttgatgactttttcctacgacagagcgccggttggatcgaaggaaactctagtaatgatgatttcttgggatggtttgatatgaacatggctcccgaattttaacaatattctacctcacttccgaccttcttttctcttcaatttcaatttaattttttcccccgtaacgaacccacacctaatgaactaacacttcctatcatttgttttattacattattatcattttattttattattatattttatttttttttttttttgaccatggggcttatcttctcctctgactttcctttaacgacatgaccctgttctgtgatgacatatttattgtttgttttgtagtacatactctattcttaataaaaacttaattaatctacaattccaatccttctatctcaagcactttatttgaattaaataattacagagtaatatttgatattcataagtgaaatctcacatcaaattcatataattgcttaccagtgaaaacattgaagtcaaacagcgttagatcccaaatttttccattctacaacaaaaataagccatcttagtataggggttattacacatcgttgtggccgatgaaacccaggttcgattcctggaggtggcattattttttctatcaacaagaaaaagctggctcatctctgcagatgattaaagatcaaatgatgaaatacagtgcattcttcggagcttcttgatgacatattaggaataacctatggaaacaagctattatagataatcaacgaacgttccctaattgtgtaataagtaattcaagttattgactctgccagtacctctgtctctttctctatgattcaatggatatacggctctttttgttcaacaatttactatgctctttggagatgtggtgaaaaaaaaaaaaggaagccccacttagaggaaactttaaatatctacgaattcttagagaatcaacttcttcacgtaactgctcatttaagaatacatacgtgccaagtgaatcattaagttatcttgaacttttctgtattaatgcggaattgaggctctagaggttgtcttatataggaagctgttatatgattctgctactcttttctctctttcattcatttactatcaaatattaatccactccgttagacacttttcgatttggttgcaaactggaagaaccattataaacgtaccaaaggatctatttttttggttgaaaaacagttaaaggcagcttgtgaaggaaaatatacaatccgagctttttcccccctacttatttgaataagtcctttgtctttgtgaatttaagtacgagatgtcgtcccttaagaaatggttgggatttcaacaaagttcgactcggaagacaagttcgagcgataaacgcagctctagcagttctagtgccgagctggcaactgctacgcctcctattataattgagccaactcgtaaccataatgggtccagtctggttcacaatgacgattcagaacgaaatacggaacccattgctatcaccaatgggagtcacgatagcacaagtgatatcagtcacgaccccttacacacggaagtatttgaatacatgccatcttatactataccgaataccattactgccgacctacccttcgggagtggatcgaccaaggtctttggatatgagaacttcggaaacacttgctattgcaattcggttcttcaatgtctctacaatctaaccgagtttaggacagaaattcttaagtatccttcgagagatggattactcagaaggagacggaaatcaagcgttgttggcgtgaagcctagagttttcaccgaggcaagtttcacgtcacagcctcaacccgcacagcatactaataagcacgtcaatggcagtggttgtagcccaggtggtcacaaccccgccgccaacacggatgggatttctagtgcagagaatagtagacgtggctccctgaaattttttaaaaattcatcggatgcaaatactaataacgcgttacctcccagttctccaggatcttcgcaggcaaagccaccacctcggccggtacacacagttgtgatgccctctgacccaatttccgaaaaattgcatgaaaattataccaagattatagtcggaagaactcagggtacatcattccaatcggggaatccggaagtgcaatgcagcgcaaattctttgccaccatcaagttcgtcttcatcttctcccaatgcactggccgtgcctcagccggtaccacattcaaattcacacttaaaagcaccctccattgaacaaaggaaaaaggcggcgctagtcaacggaccggttgtaaacgtcgataccagcttagcggattatctgccgaaaggtacaaaacctacattgtattcgggtctaaaagatattttcgaatgtattgctgaaaatgaatcagcaataggtgttgtatctccttcgaactttgtcaatatattgaaacaagagaatatcttgtttagttcttcgatgcatcaggacgcacatgaatttttaaattatttattgaacgaattaagtgatactttaaaaagagatatggaactggatactgataaacttgaatcaaaaccgacatttatcgaggatctgttcaaagggtcattatgcaatagtactaaatgttttacttgcgatactatcactgcaagagatgaaccatttttagattttcctattgagattcaggaagacgaagaaatcaaaattcaagacattttaaacaactacaaacatcgcgagttattaactggtgccaataaattttactgcgataaatgttgtggcttacaagaagctgagcgtactgtgggattgaagtctttaccaaaaactttggctattcatttgaaaaggttcaaatattcagaagcacgaaattgtaatgccaaacttttcaacagaattcactatccactggatctcagagtatgttcaagctttgatagcgccgtatgtaaagattacgaactcaacggaatagtcatccacatgggaggaggccctcaccatgggcattatgttgctatttgcaaaaatgatctattcggttggttgttgtttgatgatgagactgtagagtccatcaacgaggaaacagttttaaaattcattggtgacgctaacgaactcactacggcatatgtcctaatctataaggaatcttcagtctctagcatagattcctcgagctttgaaaagaacattgagcaattgttaaaagaagatgaaatgtatagaagaagatattccattgccaccaatgaaagtgttttagaaggcgttcctgaagaagggaacaatgaggattccaggcgtcacaaaacaaaatctaaacttttcagtttcaaacggaacgccaaagcataagctttaaacctaaaaggtaaccttcactcaagatactatagactaagaaatcttcgagcatttcagtttcatataacaaaaatctagtagtcaagtcagtggcttttgatagaaacttcctagataccatcgaatactttatataagctttttaatacccaataattatgattactgtattggtggtacatattagtacatattacatttaatgtttcatattttgttaaattaacaacgattgtactgctgtggaagggatggtgaggttcagtgatgacctctcactatatagccgcatgtgtaaatagatatgacacactttccccattatgcaatcttctgatcgcctccgctagggtagggctgatatcaatttggtccagaatattaacgtccaagtcgacaggaactgtattagtgcacacgatccttgatagtttactattcttcaatttctgttctgcagatccagagaagataccatgagtgacaatggccaatacctccttagcaccatgctctaatagtgtatctgacgccttaaccaaggtaccacatgtatcagccatgtcatcgatcaatagacatgacttccctgtaacatcacccacaagcaccatacgagaaacctcgttagccttttgtctttccttatggattaacgcgaagttcaaatctagcttatctgccagagaagcaactctcttagcaccgccggcatcaggcgatacaaggatcgcattaccgatgtcagttttatgttgaatatattttagaacacttggttcggcgtaaagattatccacaggaatatggaagaaaccttgaatttgagaagcatgtaggtccatagtgatgacgtgatcacatccagcagtttccaacatctgtgctactaatttcgctgtgattggagcacgagatttatcctttttatcctgtcttgcatatggaaaattcggaatcacggcagtgattcttctagcagaagctgttctgcatgcatgaattataatcaataattccatcaagaaatcgttaatctcttgctcccctgtaccagtttgaataatgtacacgtcctcatcacgtatactctccccgatagtgacagaagtttcctgattagagtactggtaaactccgatgttggacaagcgcaacccaagggttctagcaatattctgagctagctcgggatgagagttaccagccaataatttgatgctattggtactcattcttttactcgtttccatacagtatgtatatggtagatattacgttccaaaaaaccgaaaccagagcaccagatgcaaccaaatatggaaattggatatggcaacagcaactgtctaaacgatatagttgattatttcggactttggtccttatctacaagttaattactttcttgatgtgattttcgactcattcaaatttgtatcttttcatgataaaaaactctgtttaaagcttttcattcttccattagatattccgtacataatactataaggtgacatgacataatgatatttggcagaaacaaagactagacagcagtagttggcagcaaatactgtcatttcagcgaacatagtaaattaggtcgtaatactttcagctgttaggcttttcctcgtggtgagtaccccagattttcccctttttatagagaatccactgacatttgaatcgaattttttatgtatttaagaaacttttatttaactttaaggttttttgtatcttctgccaaaatgagagaaagaatgcttttgtattgcaatgttgaaggatctaggaaggtcaagaacagtatattgtccgctgcgaaagacttacacaagtgtttcctgttttgaagttccaatctatcgctcgttaccatcccagtatctcatatttgcgtgttaaaaggtacgatggcaagtatacaggctaacaaaaggttgactaaggaatacaagaacattgttaacaaccctcctccattcattattgcagcaccacatgaagataacatattagaatggcattacgtgattaccggtccacctagcactccgtatgagaatggtcaatatcatggaacgttaactttcccttcagactacccatttaatccaccggcgattcgcatgattacgcctaacggcagattcaaggaaaatactagactatgtctttcgatgagtgattatcatccagaggcgtggaacccagcatggtctgtagtgactatattgaatggccttttaagtttcatgacaggtgatgaacagacaacggggtcggtgtcaacctctgataaggataaaaggactctggctaagaaatcgaaacattttaatacttatagcaatttcaaattcaagaatatgttccctgatttaagagagtcgaatattaaggacatagagagggaggctgctttggaagcggaatccaaaggagcacaacaagaggaaaataaagcacagaaactagccacggagaaagcaacttcactagacgacatttcggatcctgaggatcgagtaagaattcaagagcttataaaggccgagaaggataagaaagatcaggataaaaatcctggcgagaatagcaacatcaaatcgctgctttgtctgatcttggctattgcgatttttttcgtcggtttaataatgaaatgagttcatcaaatatgttagcatcttctaggctctaagtgttgtacagtatagtattattgatattatgtttccaactatggccacaacagcggttcatatgatctcgtcacctgagatttcaacaatttaagacggcgttacataaaaaatatataaatagtcaattcataagagacaattagaacaaaaaaacatacaaaattaaaaatatcacaatgattataagccgtagccatatcattggtcatttttgtcgttcaacatcttttcataaattcatttcgcaagatattagcacatattcataagtgcagcttaaagttcaaaacttctctacctttaaaacaactttaccatgtgcacggcctgtctgcagataggaaaatgccttttgatgttctttccaatcatataccctatctacaggaataaacttgacaacttcactttctattagctcatgacatttttttggccattcatttgtcgctaatttggcatttggatcaaaataaaacatttgataatcgaaagaccatagcacctgtccgaacagctttctaatattagaacttgcagtaccccatgaattaaaagtatctttcttgtaattcgatttattatcgccaacggttgtgatgtaagtagcatctttggacaaaatggaagaagagtgaccgataatgtcataccctccaataaagtcaagaactaaattgaagctaccctggccaaatggttgagttataaaatttccagtttcattgttatattcaaccaattcattgcttgccactagatcgcttaatggtttgtagattttaccgttcgttgctgcatagtcgatgaagagcaattcatcgactagttcaggcaaatttgacttaatgaagttcataccggaggtagatgagattaacacgattctgttcaatatcctgtaatgaaactttaagagttgtagtgcaaatattccggtcattgtagaggcaccattgatcaatatattgctgctttgatttaatttcccctcttgatcaagcttgtcaaggatattgaatgcggctccaagacagtaaaaagtagatgccgcttgttgagtactgatgtttactggcttaggtaaaacaacgtcaacctttggatcaaccaaaatggtagattcacaagttcctttacctaaatttggatgccaaaaagtaccgcaaacttcatcaccgacactccacgtatctgccaaatttgagcctacttctgagatttttccataatactctcttccaatgccaacttcatagttcatatgcctagtgtaactattgaatatctttaaatcaactgggtttaaaccgacatattccacttgcacggaaatgacatctttagatattggagtctttatctttgtttcataggagaactgaggaggatgatttttggaatagaatattagcgatttaaccggcacataatggatatgtcttagcggcctagcgactcttttcatctctaaaggggaagccaattccctagggtttggtgaatcatgattatatttcaccacatatgccaacttcggatcgtgtttatttaacaattcttccgccatggtaaaagagttacagcagtatgaatttatccagaaaggcttgaagtggtaagcatccttgtgttaagggtcatggtagcggaagtctgtgtaaactccgttctaattcttttaattgacgctttttttaaatgaaatttagtttaatacgagaaacaatagataatacagaaaatgcttaaaacagagaacatatatacgatccggggtatatagtacggacttgtgaacgatatgcatgatgtggtaagaactgaatttaatgactgtccagtgcggatggaagtgtgatagtggagcttgccagaggattgataaatcatccctagaatgaaattatatacagtgcggtgcttgaagagtggtgagaaaaccataaacaaactaaaagaacacactctgtataaccatgcaaaactaatgcagataaatgacgagggtgatgctgcaaaaatattttacacagctacagcaattttacccggtggttccagatttgcttccacataatattccaccaagtcttccttgtcgaaaaccacctggatcatcaacgaacaactgggacaaactgcaatgtcttctccgtcatacatatcatcaatggaaatttggaacctgtcaccacagggacaaggatacgtaaatatctgtgtatctgggtcgaaagtcatatcctcaatctcaacctcatcgtaagtggacattgttctaatactattaataattaattctttctctttaagttaacttctagtagtcacttctctcttcaatatgccagcaccaggttgaccaaaagtttattccaattccgtacccttaggttagagaatattgaatgcactgggtatgaagacataggtattaaacataatgcgatgagcgtaatgattgactcaattgtcatttcatgtcaaaagtttcagtttttctttttaacttgttgagaaaaccgggaaaagaaggactggttcttttgaagaagtcacgtgatatttcgggactatcacaacccagacatatattttacacccatacataattcaatttcatttattttcactaatacctaaaaaggtaataagtatttttaaaacagacaaataccataatggttagccaggccgtcccaagccactcactaccggtgtaaaccccctctggcctcagaatgctctggcccacaccactcattcagtttctggctgccgtcgatatccctgcccgtctgcccagagagcaacattccatctaccacctaggcagaatctttccccaggagtctctcctccagctcacctttggccattctcacgctttctctgtccctttctctgggcgagctggttccctctggcagtccaatactcggcagtgtggtccattttgtcgaaagaacaactttgatttccatctagtgaaaagttacaaaattgttgtatactgttatatactgttaccttctatagttattgtattggatagttcttgaaatacaagaagaggtcaagaagccaggtcaaatagtatgttttatacgtgggtactattgtgctttgtggagtaaccagcggatgcaatacaatgagagaacagtgcgattacatgtttagatatatttgaaagagttttgaattgatggaatgaattagaaaatgttttagatcactgagggtgaatgacagttaccaaggaataatcagtgggaagtccgttatggtgtagcaaaaaactagcgaactgaggagattcatacgagtaaagaagcggctttctaatatcgaaggtgggaagtacgggatagtatacaaccaagaaggcgaaattatttgtgaagtaattaactcaaagagaaaacatcgttggtggcatctgaagttatcttatataactactctgtgaaagtacaagcaaaagctaattaacggcaatcaaacgaaagaaaaatttactaacatcttttactaaagcttttatctacagtaaagcaaaatgggtatttctcgtgattctcgtcacaaaagagctgctaccggtgctaaacgtgctcaattcagaaagaagagaaagttcgaattaggccgtcaagctgccaacaccaagatcggtactaagagaattcatcctgttagaaccagaggtggtaaccagaagttcagagctttgagaattgaaactggtaacttctcctgggcttccgaaggtgtcgctagaaagaccagaatcactggtgtcgtctaccatccatccaacaatgaattggttagaactaacactttgaccaaggcagctatcgttcaaatcgatgctaccccattcagacaatggtacgaatctcactacggtcaatctttgggtaagaagaagaacactaaggctgaagaagaaaccgccaccacctctaagaacactgaaagaaagtgggctgccagagctgctgaagctaagatcgaacacgccgttgactctcaattcggtgctggtagattgtacgctgctatctcttccagaccaggtcaatccggtagatgtgatggttacattttggaaggtgaagaattggccttctacttgagaagattgactgctaagaaataagtcaactccttcgcaaattaacatatacgccaatttatcaaaactccttattaaccgttattatcacagccaaaggttcttttggtcattttatatctttacaaatgtataaaatataataagtcatagtatttttacttataactttctcagtttcagtaccatcagtacttatgcaaggtagttaaaactctggctccgattactagctcaagatgtccatctcaaaagcgtgtatctacagaatgttgagaaaacgattgttatggaataatgtacgaacagtagacaagatgtatgttatgtgatataatgatcagaaaaaaaggcaaaagtgtttatctgcatgattcaaaaaagagaattcagtacaggtctgtgtaaaatttgtttcatcacgttaaaataaaatgaaaagcataaaaggccataacagagtgtcacagccccactgttcctctgaacagtgtgtttgtcgttagattcaccggacattgattgggttaatgaatgaaagtgaggttatagagacgaagaccatattctcttctaaacgtgagtcgagcagtttataaatattatgaaagcaatttctttcagtttttttttatacttcgaactggtgaaaaactgttgatacttttatactcatggatcatgtatgacgatgcaggttgttggctttagcgcagagcttcataaagcattagggcacgccataaggtgcaatctatggaacatgaatatctagtttatatgtctactctgataatcagatctttcggtccgtgttagtgcttcccatattcgacgtaaatcccatctcttttgtagtcataggcttggattctcggcacgacacaatatgaatatctttctagataacgtacctgttggtactacaataggcattgatttgaaccatttccaattaccagcttcacaaccgttccatggattcaaacatataccgaaacatgaggggaacaccgttcatatcttacatttccaacgagatgagagtgggataagatacgggtactggattaactcagatcgtcaaaagttcatcaacttccaattcgatccaatcagggaaataatggtacctcaattggaaattgacaacaactctgctgtaaataagttcgataactgccaacatttgatggtagaatacccaagcaatgagtattccgaggaatggcaagaattagtgaaatatatccgctggaaggaagttagactatggtgcgaaagcgaattcaacagcgagtcatatgtatacgtagattcctcaatgaccagcatggaagaagccaacatgcttcagaaaagggttggtgatgttagacacaatatgatattggcaccaacagatgagatcacgtttcgatatactccaattcgattcaaggaccctgaatcgatgaggcccgaattcaagatgcaagactttctcgataaatcgtggtatctaatgcaagtgatactaataaaatatcattactcaaatttgaaatcattattcggagaactacaattcagttacttgaacagcatattgttcgccaactatggatccagtttacaatggcataacataattgaactagtctgcttcagcgattgccttacagaaggaaagtataaagagattatggaacaattggatagtttgttatgcacgcagatgaagagaataccggaagaatatcgagaatttctcatcaacatagaacttttgcaaaaatgtgtcaggcgcagtaaagtgccattaccatcttggaagacgttaatccaggaacaattcctcaatgagacgtatattgaagaagaagatcaagaccacgaaggtagctacaacgaagatgacaacgaagacgaaaacgaatatgcaccagcgatagcatcccaggtggtatacactagcagataacaaccacaagggaaaaaccaatcacgtgacagctacttacgaatctatattttcagaacctgccagaggggactagaaaaaacccgcaagcgaaggagcaaatgccacaaagtcacgtgactaattgctactccggataaaaattttgacgcacaatgcggatcaagctttagtcctcgcttagacaggttaggacaggacatgacatggaaggaaattcactcaacagaatatcagacagcgcccgaatggtctgacctgaaccgtgtagtacccagcctagctcccaacactatcattacgtatcgaatcacacagaagagaacctgaaaagaaaagtggtgcttttgtggtggatcgttatggaacatctgcaatttgcaaagtgcagaaaatagggaaaaagaaaactaaaatagaattttaggaagcttctcggtctttctaagggcgaaaagtaagataattgtgcgatgagctgggattattatagaacgagaccgagaattagttaacatatgggtttgcattcgaattaaattagcaaagtgagtttttcatggttttcaattaggggaagggtatagaagcctatagaatactgtagaataggggagaagttaggatgtttgagtctcaaataattgtaaactctgattgggttcagagttacttgagttttgtatataagggtggatcaattgagggaattaagaaatgtgaagggtagttctatctctctttctcattttattattctaataattcaattgatatactagtcgtaacgaatcaagcaaaaggtattatattagtcctaaaaccactattataataagtctaaagaagagcaaagcaataatcaactagtaaagaaggaagaacaaatatgtcaaaagctgttggtattgatttaggtactacttattcgtgtgttgcacatttcaccaacgatcgtgtggaaattattgccaacgatcaaggtaatagaacaactccatcttacgttgcctttaccgatacagaaagattgattggtgatgcagcaaagaaccaagctgctatcaacccatcaaacactgttttcgatgctaagcgtttgattggtcgtaaatatgatgatccagaagtacttaacgatgctaagcatttcccattcaagattgtcaacaaggatggtaagcccaacgttgaagttgaatacaagggtgaaactaaagtgttcagtccagaagaaatttcttctatggtcttaagtaagatgaaggaaaccgctgaagcttacttaggtaccaaagttaatgacgctgttgttaccgttccagcttatttcaacgattctcaaagacaagctaccaaggatgctggtaccattgctggtttgaacgtcttgagaattattaacgaacctactgctgctgccattgcgtacggtctagataagaagggaacttccgaacataacgtcttgatcttcgatttgggtggtggtactttcgatgtctccttgttgactattgaagacggtatcttcgaagttaaggccaccgcaggtgatactcacttaggtggtgaagattttgataacagattggttaatcatttggccaatgaattcaagagaaagaacaagaaggatttgaccaataaccaaagatctttgagaagattgagaactgctgctgaaagggctaagagagctttgtcttcttcatctcaaacatctattgaaatcgattctttattcgaaggtattgatttctacacttctctaacaagagctagatttgaagaattatgtggtgatttgttcagatccaccttagatccggttgaaaaagtcttgaaggattctaagttggacaagtctcaaatcgatgaaattgtccttgttggtggttctactagaattccaaaggtccaaaaattggtttctgatttcttcaacggtaaggaaccaaacagatctatcaatccagatgaggccgttgcctacggtgctgctgtccaagctgctattttgacaggtgatcaatcttcaaagactcaagatttgttgctattggatgttactccattgtctttgggtattgaaaccgccggtggtatcatgacgaagttgattccaagaaactctaccattccaaccaagaagtctgaaatcttctccacttatgctgataaccaacctggtgtgttgattcaagtgtttgaaggtgaaagaacaaagacaaaggataacaacttattgggtaagtttgagttgtctggtatcccaccagcaccaagaggtgtcccacaaatcgaagtcacctttgatatcgatgctaacggtatcttgaacgtttccgctctagagaagggtaccggtaagaccagcaagattactatcactaacgataagggtagattatccaaggaagatattgaaagaatggtgtcagaagccgagaagttcaaggtcgaagatgaagccgaagctgaacgtgtccaaacaagaaactctttggaagcttatgctttcagcttgaagaacactgtcggcgaatctggattcaaggagaaggttgatgctgatgacgtctccaaactacaaactgctgtggaagaaactatcagctggttagatggatctcaagcagcttccacagatgaatacaaggaaagacaaaaagaattggaggatgttgctaacccaatcatgaccaagttctacagcgctggcggtaccccagctggcggtgctccaggtggtgccccaggtggcttcccaggtgctccaggcggtggtgctgctccaggtggcggtgattccggtcctactgtcgaagaagttgattaaacgtgacgagattgattattctctcatcccatacctcacaattaacgattaacgtcttttctcattcatcatacattgccaatcttatttttttttattcatttcggtagactgataaaggcttcaattgatgggatctaattaattattaattaaatcactcatgcgatctagtactctctacaattcgtgtacaaaagtccttgtacaccatggtttatacatacatatacaaaggttactaaatatcataaattatcatcatttattaaagatttcaaccacgttcaagcttcactcatcgcagcgtcgatttggcgagaggtgagatgttggcacatttgtagattctttatttcacagaatccatcgtcatccgctgcggcaggacagagtgacggatttgactttaagataattttgatatcatgtgacagcaagacatatcacgtttgacgactttgataatttttgaaaaattcgaactctggaatcgattggaaactatgactctaaacggattcgaaaaagctctagttgatttgaaatagcgtagttttatgtcacaaaatactttcgttcgtccataaaccttttctgtaagcttttgcaagctgtgatcaagttaagcaaacgacacatcactttctatcttataattaagagagaaaatggctgccgaaggtaacacttatttctctttcccggaagaggaagagaaagtcttagccttctggaatgaaattgatgctttccatacttctttgaagcttactgaagataagcctgaattctccttcttcgatggtcctccattcgctactggtactccccactatggtcacttgctagcgtccactgtgaaagatatcgttccaagatatgctaccatgacaggacatcacgttgaaagaagattcggttgggatacacatggtttgccaattgaacacatcattgacaagaaactgaacatcacctgtaaggaggatgtgtatgcattcggtatcgacaactataacaatgaatgtagggctattgtttccacttacgctgaggaatggagaaagactatcggccgtttaggtcgttggattgatttcgatgacgattacaagacaatgtatccaactttcatggaatctatctggtgggcgttcaaggaattatttgacaaggaccaagtttaccgtggttacaaagttatgccttattcgaccggttgtaccaccccattgagtaactttgaagctcaacaaaactataaggacgtcaatgatcctgcaattaccattgcattcaacgttattggtcaagaaaagactaaacttgttgcttggactactaccccttggactttaccatctaacttggcattatgtgtcaatcctgagttcgaatacgtcaagatttacgatgaaaacaaggatacctacttcatccttttggaatctttgatcaaaactctctacaagaaaccagctcaagaaaaatataaggtagtagaaaagataaagggtaaggatttggtcggtttgaaatatgaaccattgttcccatactttgtagacgaatacaaagacaccggtttcagagtcttaggtgactcatacgtttctaacgattccggtactggtattgttcaccaagctcctgcattcggtgaagacgataacagagtttgtttagagcatggtgtcatccgtgaagatacgccagcaccaaaccctattgacgatgttggtaaattcaccaaagaagtcagtgatttcactggaatgtacgtcaaggacgctgataaagaaatcatcaaaaaattgcttgcttccggccacatcctgttgaactctcaaattcgccatagttatccattttgttggagatctgatactccattgatttatagaactgttcctgcatggttcgtgcgcgttaagaccatcatcccacaatttttggaatcggtcaaaaaatctaactgggtgccaactgtcatcaaggaaaagagattttctaactggattgctaatgctcgtgactggaacgtttccagaaacagatactggggtactcctattccattgtgggtatccgaagattatgaagaaatggtatgtatcggttctgttgaagaattgagagagctctccggtgtccaagatatcacagatttacatcgtgactccatcgataacatcaccattccctccaagaagggtaagggtgtcttaagaagaatcgaagaagtgtttgactgttggtttgaatctggttccatgccatatgcatctcaacattacccatttgagaacactgaaaaattcagccagagagttccagctaatttcatttctgaaggtttggatcaaaccagaggttggttctatactttgggtgttttgggtactcatctattcggtgaagttccttatcggaatgttattgttagtggtatcgttttggctgctgacggtaagaagatgtccaagagtttgaagaacttcccagatccaaacatcgtcttggagaaatatggttctgatgctttgagactgtacttgatcaactctccagttttgaaggctgaatctttgaagttcaaggaagaaggtgttaaggaggttgtttccaaggttttgttgccatggtggaactctttcaagttcttggatggccaaattgctttgttgaagaagaattctgatgttgacttcaagtataacccacacctgaaatcggataatgtcatggatagatggattcttgcctctctacagtctttggtagcttacattcatcaagaaatgagcacctacaaactttatacagtggttccaagactactagattttattgatgaattgacaaattggtatatcagattcaatcgtcgtcgtttgaagggtgaaggtggtgtcgaagactgtttgaaggctttgaacactttatttgatgcattgttcacatttgtccgtgctatggctccattcactccattcttatcggataacatttactccaagttgagaccattcattccagaggaagtattggctcaatacagtaaggattctagatccgtccacttcttgagctatccagaagtcaacgaagatctttacgatgaagatattgaaaaagcagttaagagaatgcaatctgttatcgaccttggtagaaatattcgtgaaaagaagactatttctttgaagactccattaaagaccttggtcattctacattccaatccagattacctaaaggacatcgaagcattgaaaaagtacattgttgaagaattgaacgtccgcgacatcatcatcacttccgaggaggaaaaatacggtgtggaatacagagcagttgctgactggccagtattaggtaagaagttgaagaaggatgccaagaaggtcaaagacgttctaccaactctaacttctgcccaagtcaaggattacttgtctaccggtgaaattgaagtagcaggtattcaattggtaaaaggtgatctaagtgccattagagggcttcctgaatctgctgttcaagacggacaagaaaccagaactgataacgatgtcttgatcattctagataccaagatctacgatgagctaaaaactgaaggtcttgctagagaattgatcaacagagttcaaaagctgagaaagaagtgtggtcttgaagccacagatgatgtcattgtcaagtatgaattagttaaagataccattgactttgagaatatcgtcaaagatcatcatgacatgttgactaagacatgtaggtctgaaatcctgaaggctgaaggatcagaaaccaatccacttgctgatgaagaactatctatcaacgataccatcttcaagttgaagattttcaaattatagatgttgaaatgtatataaagtgggaaaaaatgtatagcagttacgtttctctagtgaaacgaaacccgtccgtactacttataaattcaccacatttaattaatttaattgcaattattggctccgtagatcacctctgctgattctctagcaacagtcgatctcatatcttatttcgaatataatgtgtatatgtaattctaaggcgttttcagtttatgaagttaatcgaacaaaaaaccatatctctagaccagcatcattaaacgccaaaaggattaaggttatttctatgtacgctggggaaagaagcctggagcaggccgtccggtgtattgcagacgttaatccacaactttgaagctctacatgaactgtataccgagcagtccggttcatggcagatatcacgaagaagatagcgattccgatcttgacaatgtccaaagtaacgatggaagagccgattctaatatcactgatgaaatattggaagagcgaaagctcaaatatcaaaggtacaagcaaccgttatcatcatcgtcccccattagagaccttatgagagaaagaaggaagggcagactacgggaactggcaagagagaagaagatcaatagctacagaaacgacatggaacaattcgtcatggaacaagaatacctacgacacttgcaagacatgcaacaagaagcacagaaacacgagataccgccagatgagattgatagactggtagaagatgaaggagaggtcgtgaatagtgccgatgaacccgctatgttgaataatatttccacaaagagggagccaaaacagctaaatgaggatgaagagctgatacggctgatagaactgcaggaagagtacgaatccttgatggagcaagaacaacaggagctcgaggaaaccttatctggctttagcatatagagcagcagcttccacacatatatacgtacatagtattgttacccggatatcacgtgattcattttctgtctttcccacgtgacttaagggtcaacggcatctcaaaccgtttaaggggggaacacttttgttttgtcattttccaaacagcagaaagggtataaaaagggaacacacgcgaagatcaaagcggcgcatatcatcgataactaaacaaagagcgtttttcttagctacccagtaatctgtttgagttttgcaagaaaagtgcagtacagtgctattacgtgcaagtttttttcttgagagagagaaagaaccagaaagacggataaaaagagacacaacacgattcaagagttggaacaaatcagctagacttttgaaagttaagttacaaacatcttttcgggttattagtttgaaatagagacaggagaatatttcaagagagtttgattatttttatcggtgttacgtattataggagagagttttaaaacgcaatgaaatctgcattcaaatctgagttcccatttgaaaagagaaaggctgaatctgaaaggatagtgcaaaagttccataaccgtattccagtgatctgtgaaagaggtggcaaatcggatattccagacattgataaacgcaaatatttggtgccaggagatttgactgttggccaatttgtttatgtaattagaaagagaatcaagctacctgctgaaaaggctattttcatctttgtcaatgatactttacctccaacagcagctttaatgtcttctatttaccaacaacacaaggataaggacgggttcctttatgtatcctattcgagtgaaaacacttttggtgacgatgccctgttttctgaggaatgagattaagttaaactttcttccctttaagttttcttttatgattccattaggttgttctgcttgatgcaaaacaagtaactaatgcacaattttgaaccagatattgttgaaaagatgatctaaaagaaagaacctgaataacaatattgaagtgatgataagatgaaatgcattgtcgaatgtctacgatgctattattttctattcttccacaccttttgctctagatatataccgaagcagtatttgaaatctttctgatatgttttcccttctatttatcctattctcatatttctagctgcaacagttccctagatctggacaaagcgttgcttataatacctgctgatgaagtcatatgttgccgttccataatgaaatctctaggcttttttttttcacttcgaaagaggttcttcataaatatacaattttatatacctcttcagcagattgcaggtcgaaattcggtttaatatattctttccataaccaaagacttatcgcaacatcataagaaagcaatattgatattagttgttttgtttattaagattggggtgaaaatgttatttatcaatatagtatacaaagggaaataaacaccacaacagacgttttaaactaaagctgttcttttttttaccatctcgctgaaaggttagagtaactcaaaacacactatcacctgtgcgctttttgtaattttccaatgggtcattttcaattgaatacttgtcgaaggaacgaatttcttctagtggtatcaaatctctcaattttctgtcagagtgataccattctttaatcagccaaaccatctcttgttcgtaaatatcgttggagctggtagttgtttcaattaaatctttgagaacatggtacattcggtcgtatgagacgccagcttggatgaaaatagatgcaattgaacctgctttgatgtgttcttttggaaggttctcatatattaggctacagatgtgtgggaataaatcaacaactgggaacacaaattcactggtacgtacattcttaccaacacgaatcactgttgatgatgctagactaatgaaagtagtgcttttttccagttcatccgtagcattgttctctgataaatgttccttgaaagaactgaaaagctcttcccatttcgatatgatttcctcatgatttctaaagtcactgactttgaaaatgagcagacaaatttcataataactcaatggtgcggcaaagtcattataaagttcagtcacggtcaaaattttgccttcaagttgttgcaaggcttcatttctgacagtcgaatcaatcctgaggtcatccttgagagcacggacaatttcatcttgaatgcttgctacatcgacaacttcttttatcatgccagataattgaatcatggcttgcctttggcttggcggagagactccattacagaaaacgttagctcttgacaagtactcaattctgttttgtagaggaatatcgaaatccgaaatagctaatgaatacagaatttgagctgcttccaagaaatgcgatcttttggattggtaaacccaaagaagattggaaatttctagggatttcgctgctttttcttctaagtatggtagaataaaatctgagtctagctgaagaagcttttcttcagacttttgctgtaccaaccaatcatacatttgataatggaataatttgtcgttatattttaaagtaacgttgtaaacctcatcgcgggttttttgaatatcttgattgttaacattttcaggcagagcagctagttggtcaactttgattaaagtttcgaacacaatttcatagatcgaaactctagcattgtagtattttttcctttcatcgtgttccaaagatccatctgcaacatattgaagtgccaatttacccttgtccatcgcattggcaatattcaacaaaaattcgacggtttttgggtagtaattaagttccaacatgatacctacagcctcttttatcttatctaaagacacatcatcaactattctttcaaataactttgctgcattggttaggtgatagttgagtgtttcttgatctctgagtcctatttcttttgcttttctcaagtgctcgacagctctaaagccaagaacatcaccggtggaacaaaacgatccacagcgttcttgaagtgcagtagcgatgtattcaatagatccaccttttgtaatacttctgttgatgattgaggagagaatctctcttattaaatttttggtttgttcattgggattgaaaatatccttgaatttcaacttgcttaagtcgtattgaatatcgaaattcaagtacttcataatgtcaacaaatgctaagtattgcccttcgtaaccatctacttcactctcttcgaatagtacgttcaaaaatgaaagtgactcctttatggattgaaggagtttgataactgcgttcatagcaacattttctgcctgatgcgcaacatcttctcctttatccaccaccttttctccattaattggagaaatattagtgattgttgtaattgaattaccatatgattggaagaactcgtttaaaatcattactgaggatagataatattcgatatcacctcttgatacaacgatttttgtaataatattatcacctttaattgaactcttcatcactgaattatccggattaatttttacatggggatcgagttggaaaatatctttatcccatatgtctctaaataatctggcaatcaacagagcggtaccgtagaatctagcggacaagatgacatcatcaaggttgaaattatttgcaccagatacatttggtgtcgaaagagtattggcagttttgcttaattcagtagagcttttttgtggggtcatcaaattcagtgatggtttacctagtagtgttgataccgcactgttcgcgtatttgttgtatgttggtttgatttccacaacattaggtatacctacagtgaaaagagttaacgcattggatctcaaagactctgacttattgaatttacaagtgacaaataaagcagatgagcaggtttcgactaacccataatttacaatgaagggcagcgggttgttaattaaggactccaagatctggtctgggttacggtatttatagatttccacagatgtatttgttaaaacggcaaccttcaatggttctacactgtactgagttgcaaaagcattggcatagccctctggcttattggcaccgttgaacaaagaggatatggggataacttctcttactggggcggtggtatccaaaaatacagaattttcgacgtagcgaccgtgattcttcaaaataccataatctggtacactgacaaagagcttatgttgtattggagtgttttgaacagttgctacaggtgttcccatagttcccaatgtttgttccgctggatgttttgtaacagcagaaaagaaaatgccaggtgaaataattgacgaagctttcgagctttcaagtaacactgacgattttttctggtatttcaactgtacagattccatactgttgagggaagaatagaagggtgtaagttttctagtttgttgctgctgctgctgttgtaactcaatttctatggtttctggactgacagaacttggtgggaacttgatggattctaatcttaaagcttctacgctaccagaattaacagaaccattgaaatataacctaacaccgccaattgtgatagctaccaaaaataaattgttattctcttctttcgaaaccacctctactttaactattttcaaatatttgttacccaagatagcagctcctctagccggagtcgttcccatgatacgtttaatataagagggttcgattgtagttggtccatctaaggatttaccattaatcttataagctcggatgactgattttgatgataatgagtacaaaataccacgcgattggtctacagtcaaatgtgtaatgtattcttgtgcatactttgaatcttcttcaaataaagattgtacaagtgccgagcctggaatcttggagaaaatatttgtggggagtaaactcaaaagagcagactgtgtcaaacaaagtttgctgcatttattgttaaaccaatcttctgaagatgaatattgaagttcccaaatgttggtcccattgctgttaccagaaaagaagatttgtcctgttttctcataataaacgatttcatgtacatccaatccatgaacagaaacgctcatccctgtgttgaagatattgaacgagccgctgattctgtcataagaaattgcgagtatgtatatgtcaaaaggagttgttatcaataacaagtggttgattgattccacgaatgtatcaggtttcggtttcactagggcaacttgtaatatggtatgcttgatgtcatctattgattggaaatctgaagggttattataatgccagaggatcaacttgctatcaacagtgatccaacaacgttcaatatcgggaaataaacccatatttgttttgatttcagcagtagatacttgctgcaaaatttcatctggtatgttaatcacattaagtctttcaaacggagtaaatgggcctaatccaccaacttccttggaaaaattgtagttaaccccattattgtagtacgatctttcatccagtaccggggtactaatgtcacgacgcaacaaatgatcaatgtattgagaggcaagattcagaggatttgcagcaccaagacccgttaccttaatatgctcatgtgaagcattaaagttcagtgggtttactgtgttgccgtttaaacctgaaattacgtttgtcatattagcaccgtacgttcctatagtaccgtctgatccttgttgttgaggcaccaaagaggtattgccaattccattcatcggtagcccgttgacattggcagacgggttggcaaagtttgcattgccattccaattgcttttcaacggcgtagaatatattgacatctgtcctgtcttgccgatacactgttagctcaagtctataccctatttccgaaattcaaaaaagacaagtacacagatacagtaaagcaaaattttatgctgagcaatcagttaaccaattggacaaagtgcccttagagaaacataactgttagacctggttctgcaaggtagatttagaacatcatctttatttgtttattcagagaaccaaagaaaaaaatttgaaaatgattacccggaactggtgatctaaactggaacatgatagtgaactcataaaggccaacaataccattacagttcgacagatcaactttattctagttgcaaagcattcagtttcttgatttcacccataagaaacatccagtgtatgttttcatgtgatacgtgacgatatatattagtattagcaactatgggtactttatcatgttcatttattttgacacttttgtgacaaaatgtcaataaattggtactataggtaatggaatataaaagatgataccagaaaccttgggtcctgattataagttcaaaattaagtaaattatcaattaaatctcctgctttgaaaagtactacccggcaattttcctatagaaaagcgttcgctcaaacagaaggcaaaaatggtcggaaagcttagaagaaagatcccattggataaccaagatgttaatacccagccggcgaaaaggatgtgcttaaaaaaaaatatcctattggaagatttgaataaggagaatattccgattgaaataccttacttaaacgaaagccctcaatcagctagcagcagccttacaggggttttgaacttacatctcgaaaaacaatctccacaacgcaaaaggctgtccaccaatatagagacggacactgtgttagatacgaaaaagcaagaagttttgacttctttaaagttagaagaattacaagataattttaaggaccttgaaagaagattaagcattcaaaatcgtgattatttcatcaaagacgctcactattcagatgaagatttgacgaagtgtagaactaattttttgtttgaattggaatgcttaccaaacttgagctggtctcaaaaaggtaaccttcgaactgctagctatattccgtcagtgtaccaaaagttggacccaaattggtatttttcacaggcgttttcaattgatgattttaccaacttgcctgaatcagttaagccattctatatattaaacccaatgaatgaagtaccagagtgcaataaccaacaaattgaaccagttggaccggaaaaggcaactgtgcatattgaaaacatcgaacctctttctaaaatgatacccagctccaaattaaaattccgtgctaagtcgtgtgcttttgatgaagatattgattgccaactgttgtttaagcagaaaatttcagattgtaactattacgaagacgaagttgatcaaatatcactaccagatagtttggatcactgtagatctgttaagaaaaaggttacggacggaaagaaatctttgaacagaaactctattctattccacaccgataaaaggaactagttagaaacaataattatggctgttcgaaaaccaagataattctgaaacggtgtataatatttatgaaaaatgtataaaacagaataaggcaaacaaagctcaaactatccaaatacactgtgtgcacaagttatgtcactttcaatcgtcagttaaataaatctgtcatcgtgcttatggcacattttctaaggttcgggtaaaaaacatgaaatttgaattaacagaagcaatgaacatgaatataaagacaaacatacttgacaaaagaacggcttttaggcgctgtgtgttagtgattttaccaactgcttattagctgtttttgaatttctagtgggtgttatactactgagtgataagctataaataaccagaaatgttggtgtttagaaggaactatgctaagaggaatactggttccaaattcaaaattcttcctgagtataagttaaaatgcggacttgaaatccatactcaactgaatacagacaataagcttttttcaatgtcaactaacagcccgtttgcagatgtggataagccaaactatcatacatcgtatttcgatgtttcgatacccggaacacaaccaatactcaacttgcaggcagttctatttgcattgaagttatcgctagcattacgatgcaaggtcagtctaaactcacattttgacagaaaacattacttctatggtgatcaaccattgggctatcaaatcacacaacattacaatcctttctcaagtaaaggtaaactacgattgtacaaagatttagactctattgaagaggctttcaaagacatatctgtcattcagttacagatagaacaggatacaggtaaatctgtatataactctactgactccaatacaaaaatcgacttaaatcgttcgaatgtgccattgatcgaaatggtgactgaacccgattttacagacctaaaacagataagagctttcatcaagaaatatcaaaaccttgtcagacatttgaagatatctacaggtgaccttgaaacgggcgcgatgagggttgatgtaaatctttctattaatgattacgccagagtagagttgaagaatttaccaaatactagctcaatcactaatgctatcaaatacgaatacaatagacaagttaacatgatagaaaaaggcgaaggtgaccaactcaaacacacagaaactaggggatggacaggttcggaaactgttaaactcagaactaaggaaagtatcatagactacaggtatatgccggatccagaactaccaaatattcttttaaccaatgaaatagttgaaggagtagaaaagacaattccaacgttaccagacgatacctgtatgatgttaatgcaagagccctacggtctaactttaaaagatgcaaaaattctcacaatcaatagtaatggccatgatgatttgtattcccatgatgaattaagagcatgctattttagtacatttgatgcatatcactcattatgcaagaaacaaaacgaagagttcgtgagaaaactacctgcaaattggataattcatgaacttttgggaaacctaaacaagatggaaattcctctcatcaaagtttcccatattctacctccggagaaatttgctgaattactcttgctaatctctaagaaaaccatcagcaacgccagtggtaagcttttattatcgcatattttgaattcctttaaggagaactcttttgtggcttctgagccaataaatttcaatgctctaattgaggaatttgagctacatgcagtctcagatgttggttcggaagagctcgaattaatttgtgaaagtataattaccgaactcaacaataacaaaatgattgaagatattaaatctggtaagaagaaaaattctattaagttccttgtcggtcaggccatgaggatatctcaaggtagaatacaagctcaagaattcgaaattactttcaaaagacttcttggtgttgaaccgtgattacattccttcgctaacatgtccacactatcatccatgtaaatacagaatagataagttcataatgaacatactacgatccaaaactattttaagattattcaaaggataattcaccgaaataccttttaactacctgactaatatgaaagtatataccatttataaaatttccttactataaaccttgtataccaagtgtgtagaaccattctacaaatactgaataaaaatattagggtacccataccattgaaaagaaaaattaggcagtcaccttcttaaggtaattgcaacaataaacaaaatccaggtttggaagaaatgaagaaatagaaacttcaggctataattagaggggaaccgaacttacaatgtacagtttttcggaaagatgaaactactcatgggttgtgtagttgcattagtggaatatcgcataaatttcgaaacgttgaaattctttaactccaaacgctcatgtcagaattccagatggaaacagaagaagtagttggttgggcagaagagtcgttattccaagtcgaagttggttcagagagcatgaaagtcgaagataacgaacttgaagagtataacccccctccataaggtagttgtggatcattattttcagtaactgatgatgacgaaggtgttaaagggttcataaagtcatgaccttgagagaaagactgttcgataaaattactaccaaaagttggaaaagattgctgttgcatgtggaatggctgcgaatgcagtggttgctgatactgttgaggtaaagactgtaaactctgatgttgttgtgataagaaacgattttgttgctgtccaatggaacgattattgttcatgtccataggcaccatgagatccatatcgttacttacagaagaaccaactgacaccgaacttagagtagatgacaagcgagaaggggtaattggaggaggtgtgacacttgaagtaggactgaatggtatatgagaagctggaagctgggacatattgttaacatttccatttagttgattcagagacaagttgctattgtgtgcgctgttgccatcagttggagtgatattactgtatccattatcattcccattattagtatcattcaaatgagcattgaaattggcattgccgatattgctattagagtaactgctattggatgtcgaattgtaacccgcataatagccagaagaatacgtctgttgatgcactgatttgttgtacatgctggttactgattgttggtactgttggttgtacttaattgcattaccttgttgacggtacgctgtgttgtagttattgttctgggtaaatgttgtgccattattatatttcttgcgattattattgtgttgttggtgctgattctgatgttgtgaattagtgtagctcgagtaatgtccattattagatttcacctgttggttatatctgtgtgcagcttggtatggatggttttgttgctgctgagaagcctgtttcaaagtacggtatttcaataggtaggtatccatatcctcaacttgagaaaaaaatgggacgtttaccaattgaccaggcataatgatataagatgggattggtatatgcaaagaacttttcaaacgaataaaacttaaaaccgagaataaaatgacataaaactttggaaataaaatgaagctttcaaaagaagacaaagggttttcatgcaaaatgaagaatcgttatttgatactaaaaccagatgagagagaaaaaaaatgctaagtcacaatgaataatagcttcactggatgattagttgaatgggaaataaataattgatgccgatcagcacagaaatgaatttgcagggcactcaataaataatttgggaccgaattatgatgatatgaaataaatgtaaagcagagtgtgcaccactaatttcagtgcttgatatccgtatatttgggcagcaaaaggaaagaaaaaaagtataatgtttgcaaagatgaattaccaccccagagttaaccaagcccgtaaaaagaagaaggatcgacgtctattttgttatttagatctgcttcttcgtcactttatgtgattgcatataaattaaatgagtttcctgttggcaaagttcaactttttttcattttaaaatttttcctgttcaaattcatgtcaaagaagatagaggaagtttatccaacaacgaaataaatgaatgagacttcagcgacagatttaagatactaccaaaactacagtccattaataatcataactagtaactaaaataatatggcatgatgtactcattccggtttaattataatttgtctaaggttggttctttgtcaattctgtttgaaatttccttgcggttttaacaggaacttatgtagcattatatttagttatcgggttccagtagtctttttcttagccttgacttcttcgtcggtagttgcgtgcaatcgaatgacgtttggatagtctggcctgtttcctatatggccttgatgccagtcataacttagtgcataggcaaaaacagaacccgtcctattgaattggcaaacaggaatggagtagtttaatttcgggaagccttttagcctgtgtctatggtttttatcccagaagtggaaagaaccgtccccaccagcagtagcaaacgtaccatgaatagggtggaatactatgctatttacagggtacacttggacttcagtagacgttctaccaccagcagcaccgttattctgcacttgttgacgatggcatttgaacgaaaaaccgtctttcctttgttcttgttcatcaatgtattgaacggcacaccttccctcgatagaaccaattgcaaatccgttcccctcattataacacgaaatagaccttgtttgccatttcaaaggtgatagagatgtcttaaagatttgacctggattattcaagtctattaccgctatatgtctttcagccatgcctaccaccataagtttttgtgaagcatccatgcagtacactctttcgggcatttgtaatgtcattatcggctgtggagacctaagatcccagtactttactgtcttatcccaagaacccgtagcgatgcactcttgattggttggtccacatgatacaaatcttaaagattgtacagcactgttgtgttgtccgatctgctgtgcttgtcctgtagtcacgtcaaatacttttaagacattatcacagccgccacttgcaactttagttccatcgattgaccatctcgtagttaacactggagcttgatgatcgtactgtgcccttccttgaggggatccactttggacatcccatattctaactttgctatcccatgaacttacactgaacatgaagtctgactgtggagaaaaagcaatatcactaattgaatcctctgctgcattgtttaaaacaatatcatttgctaagtctttctcagttgccattgttgacggtgtggatgatgacgatgagttacttgtacggtaaaaggacattatatgccatgtagtctaaccctgcaataataaagtaaaaactttccaagcgaaacaattagaggcgaattttagtacccaatatcttatcgtacatctaccgtcttacgaaatcgagatatctaatatctttttacttcctcacgtatggtgagctttaattgtttatgttcataacatccaagcttgagctgagatgtccaagtatcattatgaacgattagtgatagttctatattaaaatgacatcgttatctaaaggtaaactaaatagccaaattggttctggcatatcatcaagaacgtattcgaaaagttattatgatacatacagttttattttgtaatgtgaactactgtaatgtaggataaaagaactgaaagtgcgttgtccaaaaggaaaagagtctcacattttaatgatacaataaaatactgttccgtcgcgcagttaattacaggaatcgaggagggaggaaagaacaacgggaaggtttggtgtttatcaaattaaaagtattgtggaattgaggtacaatgagcggaattgtattaatactgcaaacataatttgactccagaacaaactgaaattctaaatgaaagaaacagtgaaaaagtaaaggaggattggaatttacacagctagcagtgtgaccacaagtgtaaagggaatctaaatccaagcggtgtgcagggaagttaaattaactttatgcttagctattcacatttcactgtattatcattgccaattcaggaagttgaaatcattatagctattattcggatctaagaaatccaaattgaaaccgctttgatctaatttcattttctcgctgttcttctcgtctttcgcaaattcatcgttagaatcgccctgtgtatcgcctttcttcgcgagagaggcagtttctaaagtgcccaacattgaatcctcattgtcagcataatcaaatgcagcagaggcgttcagagcaggatctatactcataggatcgaagtcagtatgtggggttggatcggtcaaagcattatgcggcaacaatccaaggctattattactgccaggatccttgctgctagctccggtggagtcctcttcttcgatgttgttctgtggagttgtcgtaatatctactggggttttctttgcagccactttctttggtttattcgttgttgtggtagatgaaacggataattgcctagtactgctattcttacgagctcgtttattgccagcgggggcttttccattttccgtggatgcctctgtgttcaaagtgaacggagaattattaaccaagttacctttcggagttttatctcttggcgagttgtttgcagataagtgctcgtaaacggggtttaaattagatgggatattatttctatttccagatcctggagtcaatgcagttgtattgggcgtgtttggtgctgattgagatttcttgaaatccttaaccctcttggtatacttccgtttctttggagctgcagcggtagcaggtggtgcagttcctacatttaaaggactttggttaggaggagtagcaatctgtgaggaattaggagggagcattgggtttgaaccctttttgtttccagcattcccagatgtagacagagtcaagaactggggcgtagatccagaagacagggatgtttcctttgcgatggataaaacctttttgttttccttttctagcattaatagctctttctgatagttgtatagaccatccatacttgacatttcaaatgaaggattcgtattatgatgcatgccatttacgtttgaaccagggattgtattcatactattcattggcatgttgttaacaccaatgttactggacagatgcgaagaatagctaggggcggacagcatgccttggactaacgcagccgattggttgtgaggaatttgggtttgagaatttctttgacttggcatcgccggtgcagagtttggaatgttcatattgatgtaagttggaatggatccaaattgttgggataaagaagatggttttgaataaggagcctggccctgacctgagcttgggatttgagtgggggctaccatgttgattgcataggatgacgatgaattgggcgtcatgtgttcattgtttatgatgccttcatttccattgacattgatattactaccgttattagtgttaccattgtcactactattgcttacattattagcagtgttatgagaattggttggaacagtaccagtaccagctggtccactattacttgccaacggtatagagtttgaaacaggattagagcccatacacgcagcttgttgagcttgctgtgtattgttataaggattcatagaaggtgtataataacctccatttggaacacctggtacaccattatagaagccttgaagatgatgttgcatttgaagatgatgttgttgttgttgatgttgctgtacactagaggggtgagtattattttgttgacgctgaggttgaggtttgataggctgttgcggttgttgttgttgttgttgttgttgttgttgttgttgttgttgttgttgttgttgttgttgttgctgttgagacgacgctgctgaatgagtagccatcggagcagtgttggagttatactgaggtgtataccccgggaaattagccgaggaagccgaagaaggcacacttggctgagccgtctgagctactgaattggacatattaaattggttattagcagccatggaagcaatggacgcgaattccattggatcgaacatttcgtgctggtaaaatcctttctgctcagcagtttgttgaaccctagcaacatgcatggtaactcctctataagtatgttcttgtcgttgccgttgaagttgctgttcgaaatatttcttagcgacgtctgatccgcctctatgagtccttgcgttaaacacgtcccaaaaaatctgccaccattcgtaaagaaacccctctgggacatcatgcgaggggtccagccttttctcaacatcgagaagcttcgcttctcgttcaaatgattgtgctgtttcgttcaaatttgattttattagaaagtcatggatgaaagcatcgagcagtttcttggttcgcaaatcgtcgtactcgcttgcattaaacaccatagtgtcctgaacaggcgaaggatcagaaaccatgcccaccggtgtacctgccaatccaggtgcgtttcccggcttgccagtaccatacgagttgctgttgctgctgttattgtttgtattgatattcggaggtctgttataattttgattatggtttggagtactcccaccaccagcagcggctgcggccgccgcggcctgcaacatcctcgacctttctagcgacatatgacctggctttggagcactccatccagtatcagcaacgtctgactgcccagagtacatctctcgcttcatgcgttgaaaatacgtgtgtaaagaacaggagacaaaaacacggaatctctctctctatctctcaatctcactcactaccggtactgattcagcgaatagataattggtctctaaatactgtcacacacactttggcacgcactcacaatctttctttctatctctctaacggatcctagctaatagcccgcctctgttattgtttctgtttctgtttctgtctctgttttatctcattccttcagtgaaaaaaaaaaaaaaaaaatacagtaccgttctttattgtaatttcagttccaaattgccagctaattttcaaactttaattgtctttttgtactgtcgcagttttgtttcttgctggctggtgccgagtctgtagtacttatccaggcttccaggccgcagcgatttcagtgttacccaagaatccattgaactaacctaggcctacctggcctagcccaacctaacttacataatatgtacataatatactctgtctcttatctaagtccctctttcctcccccatgacttgcggacgttagcccaattgtgcacaaaggctactacgatcggatgacaaccctagagtaggtaaacttctggtgttctggttggttaatattagtttggaaggtacttgggctgtacccccagctagggtgaattatatggggctaacaatcgaagatcgtccgtcaacttattctctgggtgtgcaagaatcatcaaatcacgtgatatatgtatttttacccatgaaagaaacgttcgaataatcatccgattacatgaaaggtaaataccacaggagcctcaggcaattgctcttgtgtaattttttgacaccccaagggtaggatactgtaatcaaccctacccctgttgatatcataatgttagtcttggactctgtcatgccgcatgctttgaagagcatacggacaatcaatcggaacaactacatgcttgaatatcgtggggtgtgaagggagaaaaggtgccggcatttgttttcatatggtatgtacgggtgttttctggacagatatttttgttccctgcttttagccccgccagttataacggcaattgaaacagaggaaaaactccgtaccaaaggcaagaacgctgaacggcggtgttcaatgaggggaaacaaaatgtcgatgaaagggcgggtaatgatggtacccttttctgtcacgtgacgaacactggacactctatgaaggagcattattcgtacggcaacaggatgtcccccagctactcagctttctcgtgtgttgtttcgttatcaccacttttcgagtttgcgggtcctcttaagaatacagccaataacagtgatgtgttacacgcgtgtagcagtgtggatgcagtagcgtttggcggatagctgttccagcaccactcatgtgttaggtaccatagcacacatagcggatacggaacattggcccaattcaatagtactggtaacgtccaatggtaccaagataggaattggtagtgtaatgatcgagcaaatagtactccaatgtaattggtaacaagtaaaatgtatgcaatttgttctgcgtttactctcatcgcactgaatacagcatcggtaaaaggatgtaaaaggttagctttgccaatcttcagtaaacctgccggtgtattcatgttcgttggtatcagcttgtaaaacaaaaacacgactaaaacaatgacatgagatattaatagagacctatggaaaagtgggtccaagaatacttcctcgtctaccatttgccagttcactgaccatttgtacatgaattgcctgctgaaattgaacgcgctttgcaaatattcccaaggatactctttccaaaatggaatggctattattacctgccaaataaccatcaccgctaagtttagtacgattttgaaagtattacaacgctctaataggtatattgttaacaacacacctgggagatatagcaatgcgttcattttgatgcttactgccattgagtaaaaactactgccgataagtaccagaaatcctctaatcttatacttcgcacaaagtatcattaccaacacagccaaagacataaacaaggtcgtaaaacagtcgttgaaaagtcttagcacgtaaaccgagtgtaatcttttggaaagtatggcaaatatcgcatacccaggaggtatattcaacaacccaaaacacatgaattgtatcatcaaagttatcacataaagatatctgaataaatcttgagcttcgcttatattctctaatccatcacttacccactcaaatatcttgtatatgaatacatgacctgctggatataccaatggtccagttccgccttttatttgagaataatctctttctccgttttgaatcatccatatttgttccatatatgcagtataatcaatctctgtataagacactttattttgaatgaacttcattgcaatggattctaaaagtatcaagacaggcattgcaatagcattggcctcgggattccacataagataattgaatgcatctaaaatatcttgaaatggcgtaaatggcggacgtacaaattccttcggttgttgatcgtctcctacagtgggagcccctacagttttattagcgccttcttccaccatttccttagatgtagttagcgcaattcgttatggcttttctccatatgaatgtttgatcagaacaaggccaatgttattgatgtattttacgtctcaatgtgagttttcgttttttatggtattttatctatgttgtcacattctctttaaatgtcaggaagagaaaacgataatgatacagagagcaacagttgggcagcatctttcatgtcaaaagttatatcttgggatgaaattccatacaatgtagtatacaaaatttatatggaatactaaaatacataaatacgagtggtgtttcgttttgttttggtgcagcatgtgtcataagaagaaaggaataaagacaaaaagagatttggacattcaagcaataacttgagccaaaaccgggttttgggcaacagcaccattgaactgttggttcaaatgtttcaataattcgatgacttgttgctttatttcttcggattggaactgttttctcttttccaagttttcttctctgcctaaggtagagttcgtctctaattcaattctttcactttccttctcgaaaacagttgcgaaaattgcgatgacctttggtgcttcattgatgatggtgctgttttgctcttggaataacttcaagaataatttgaagatcggatcgtattcttcgaatgcagtgttgaatggcaagtgcgagagtagagctggaatggtgtgttccagtggaactaggttttggtgcttcaagatcattctggccacacatccgcatacgttggagaaagttctgtcaacgatttctttggtagcttcatcatcttcagtagctaagttcttttcgtcagcaacgctcaaaatttcgtataaggattttagaactggagaatagatagcagaaacatcgaatgatgaatattcaatcaacaaaccaacaccgtatgaagcattacatctgacttctaatgatttatcattagtcaaactgatgatcaaagcctctaacaattcttgaatgaatgggttttcatctctcatgcctaaagcgatttcagatagagcaccgacggcaaaggatctcttgttcttggacttggattggcacaattgcaagataaccggcttggctgtagtaaacacttgggcgaaaccaccaaccaagttagtagacaaagcgacatagatgtctaaagcgacgtccaacaaagtagcttcggtttctgaggcatctagatcttcgtcttctgggacgtcttcttcgaaatggatggtttgacaagcatgttcacccttcaaaacgctcaaagcttcacgacatagttgatccaaatgggtagagtcaccgttatccatgatgatgattggaccaaacaatcttaacatttcagaaagatcttggaacacgctgataaccatagaagtttcaacctcttcgataacattgttcaaagaaacttctctaacagtttgaataacggctaacgcgctagcatcgacataagagcctgatggaacaccctttggatactcaccttctttcaagttggcagtcaacaaaacagctttaacaatagcccacatggagtgtagagccgtttctttcaaaccatatgactcattgacttgctcagctaaaaccttcaaagatggttcaacgtattccaagaagtgttctttggaagcaatggctaattctgacaaagcagcagcagcaacttccttttcgtatgcgataccagtgtttacggtaaatttgctttgtagttcttcttcatccaaatcttcgatgccttccaagaagtcttcgtcaccgtcaaagttaaattggtattcttcttgttcgagagttttaaatatttcaggaatgatggtttgtaggaaaggagcaaagtccttaccataaacctttgccatattggcaatgaaggcgtaaccagactctctcaatctagcagaatcagttttgatagcttcgtaggcagcgttcaccaatggctcagcatattcagcaaaagcagcggatttgaccgctctacccatggtggagatgttttcgaaagtcaaggccttcaattcaatgtcgtcttcagacaaaccttcgatttgggagacgttttgaataaactgttgcaagtattgaacagatgtcttgaagtatggaacaaatcctgatccggcagcaaaggcacaagaaccaattgcagaaacaatagcagctctcaattttggtgattgttgggtttccagcatttggaacaatttgttcattaatggatccaaatatttaatgatatcattgtgagcaatgaattctaatagaccatccaaggcaagagttgcgtacttgtagataaccacatgcttagcagagtcaatgatatcaatcactagaggcaagtattgctcatgatatctagcaacttcgtcttgcaaattggtactcaactgcacaatacattttaaagcagctaattgcacgactgcttcagagtccttcaaaccagtaacagtggcaggaatgattttatcgaattgagataatgtgtaatctggagagccagtaaccaatacagaaattgctaacaagattgatcttctttcgaatgggttagaagaggacaacatggttggcaaatgttcgataataggaacaccgacttgagatggggatagttccccagaagcgttagaaatcaatctgagagcagtcaatgctggggtgttttcttcgttctcaccggcttcgtcttcattagtcaactcatcttcgacatcaatttcttccgaagcaaccttcaaagcagccaaagtgatctctggacccaatttggcttggtttattttagattttctgtaaactaaagcagaagtaacaaattgtactgcaaacactctaatatcttcatcgacatcggaattgacggcaatttgtaaagccaatttgaccaaatcagcaattgtgttaccagttaattgagagtccaataacaaaaagtcatttaaacagttgaagattagctttgtgttagtagtatcaccttctctgatggtggcatccagaacctggacgacggaaggaatcaaagaagcaaacttagcggcatattgtggattgatttcaccttcttcttcgattaaagaggagacgtaactcaaggcttgcgcagacaaagatcttgtctccaatgatgcagaatcgttaatagtttgagcaaacaagttcaagaaatcatcgatgtgtaaagccaagttagcattaaaggattccaaaagggacaagataatgaaaatagcagtttctctaatttttgggttactatcacaagcagcttgtagaaggtttggaatcaactctggccatttcttctcgtctaattcttcggatccaatggaggcaatgacacgggcattagcatggcgaacagcatcttttccttcgttaaaagcagagttcaacaaggattgctttacgcttgtttgagtagcagcatcaagagaaccccagtgcttagaaacttgctttctagcttcaacaccggctagttgcttgataccatcatttgaactgttttgcaaaatgtgaatcaaagccggcaaagcagcagattgagtgtaaaattgtgattgcaaagtcttggtagcatccttcaaagaacctgtaggttgaacaatagcacctaaagcttgctccaactgagccacaaactgttgatccataacgggggggggggggggggtagctttgggtatgtaatgagttagcggcgcactaaggactgacgtaccggtttataaaactgataataaaatcacaggcctgagaagttgttaagaaaaggtttcacaacaaaaagaagaaatacagtctttactcctatgggctagggtatacttattcgaaatgagcaaccttcaagatcctttcgcaacagaaatgagaacagtaatcttttttacctcatcgcatcgcatcgcatctcatctcatctcaaatttaattctttttcaatatcaacaccgaaaaccagaaaccaaaaaaaaaattatgttagctacagtgggcttgttgctttttgtttcgtaagttatgatatttaagatgaatcttataaaggtaaagtctaagtaatgggccgtgtgcattttatacgtgcaccgtatgcgtaaataaaagtcattaaaagttagaagtccttagcgagactgagtcttttccatagagcttaggtccatctcgatgtcattcaacttagaatcgatattgtctatggacataccaataagttttctgaactttgatattttactatctgaaaccagttgatctctagcgtatttgatattcctaatcatttgtcttctcttgaactgcttgtaacacaattctaccatcaattttatggattctttcttttcgaattcattagtagcttccgtagatgagtcctttgagagacagttttcctcatcctgtactaatgtagcaagtgacagcgcttgcgaccgctccatatagttatccaattcaatgtttttcatcttcagctgattttgggcggatcccaacgtatttctattatttgaatcggagagtgccttttctcttgcgttggtgtgcttcagttggttctcgatctcttggatttgctcttctttcagctgtatactatattgaagattatcaagattatcttcaattatgttgctcaaagattgagtaagagaacccaactgagcagtagacttgatggttggagatgatgatttttgttcttttcgtactctttgagcatcaggtctacgtaatctgttcacaggcttcactaatgttggtggagatggtggatgcaatttaattgctggagttaaggatcctttcattttatcaattgataagacatcgttacggtcgactatgttgtttttcctagttgaagtctgtatactatccactgtggtgtcattgaagtcgtatttgctggtgtcatctatacgctcttcttgactgtttcgaggagtgttcgccaagaaagttgtcttgggtggagattgtagaatctgggcaggaagcgttggttgaaatatatttggaactgtgaaacgagacagtatcatagatactgtctgattttcaccgttaagaatatctggtgacgcgccgaaatatactaatttctggcataaatcaacgttcttattgagggctgctaaatgtaaaggggtatttcccaatgtatcttggtgattgagtgacattcgcagcagtttctcatcctccttggcaagtgtatccaatatagtgtccatataatactctatgacatgaggttctttggacctgtttactgtcagctcgactaggtagtgcaagggtaatctatgatttgcatctggtgttactagacatggatttaacatagatattatttgttggaaagaaacggctttgtaacaattgttgtaaaagactgattttgtcaaacaattgaagcccttatcattacaacggagaagatctgcgtcttggactagtagtactctaatcaatggaatgtttgacatagcgacagcccaatgtaaagacgtatgtccttggtcatcgattaagaagtttatgtccaaattggatggaggcctataaagtgcttcgggtagcgtaggttccacggaatcgtattctgaagataaaacctccaaaatgagttccttataatattctgtggacacaccgttcttatcatgagctgatgagagtggagttggtgattctgatgagctagacgaagctttatcgttggaggagaaaacttccattgaggatcctgtggatgtaacgtttgagatcatagacccagaagaatgccccatattattactgccagcattgccctgcgtcatttgttttagtattttcatgttatgctgagatttcatgttagagttgactggcactggagccacgttgtttgtaacaggtaccatttgttggaactggtgtgtttgtgggtatggataaaattgcaaaggtttctgagtagtttggtatttgattggatggtttgcttgagaaataatatcaggattcaccttactgaccggtaccattggagtatcttgttcagaagccaaattaggaagcttttcagtactttggttactattttgactctgatgatgatgttgctgttgaggtgtttgaaacataacattgtgtaagggggacggttgaactggtttatcctttttcccagatctccttatagattttttcttcattggggtctttgcattcttctttggtgttttcttataagctgatggtgatgtaatccttgcattcgggtccaatttcttgatctgagatacttttgatcttctaggaggcatatcatttggatcaggaataaattctacaatccttttgacaaccttattgttaatattgtatttttccaccagatatttagtcgattcccagggtatccaggtcccctggaatcgtccataaccaccctgaatcttttcatgtttaatttcattggcctctttctccaagatcttggttctctgagcctttgtaaacgaaccggctttgaaaacttgcgttatgttcaaccaattatcgttgcatcttctcatgataaggcatggaggtttatctttggtataacattcatatacatcaacgcccgcgtatgtagcaacttcaatgaaagtttccgattcgctgtcataaccacttgtctccgccatagtaggttcctcactgattttctttaaactcccatcgatctgcctttcatcgatcatcgaagaggatgctcccgtggatgaagaagaattattggtagcaccactattagctcctaataaattagaattgaacggtttcaaaagtgtatcattctcagaatgatgatgagtgcccatgtgcatttgaaggatagattccttgtcaaaaacgttgccgctatgatgcgacaagtgttgttccataattacacgaaagaaataaatgcacacgaaatcctaattgttttagacaaaacaaagcaaagaaaagcacgccagagtcaacaaagcgtttcgagtcgagtgtcaccttctgctgctgcttctgcttctgctcctggcaatgtgatctcaagctcgctcactttgtaaaattcaacgtaaaatataccacgcagttacggttattctagcttttccaccagtgcccaaaaatgtatccagatatcggagtagcagaccaaatcaatctcaactggaatgctctgatatttagctaagttcacgtagcctacagacactgttaataacaaaggtatacacaaatcataaatgacattgtaaagtgcgtgagaaagtctgctttcaaaagattataatctttattttaaactgtgatcaaatctctttacccaattgggaaaagaaagattagatgcctcaccaaaaaaaaaatctcagatctcacatttcaaacctcactccagtgtgttcccatattcaaagctgaggcaacctttcaaaacgcctagaagggtccgtatgacacgaaggagtaggggggcagaaacagtcttaaaagtgaaaaaataagagaaaaatcaataatcagattatattcacgtgtcagtattacccgggacactcacgtgattcgaaacttttaagtgttacccggtaaatgaattttatgaaatgtcgagaatgctttttccagctcaatgaaatttggaaaaactgaagttatattgtaattggaatttaaatattgtcaatgcaattgtatgcatttggttcgtcctactagggagtgttacataactcaaactacagatacgcagataagcaacaaagtctaattcatacttttttccctcacatttttccttctccagacagacagagtcctaattttttggtatattgtatattgttccggccccaccctttcctacgattaagttactacggtttgagatacctaaagaaatacgacagcacgggcacactataattggtaaaacagatcaataagttataacataaaatgcttccattatatttattgaccaatgcaaagggtcaaacaatgcatgttgaactaaaaaatggagaaactgtggaaggtacgctatctgatgtagacaattggatgaacttgacactttccaatgtcactcatgtagctagtggagagactttgaaattaccaagcttctatttgaaaggttctttcatcaagtatgttaatttgcaagatgatatcatagacaaggtaaaacaacaatggggtcaaaacagaggcggtaaagacgatagaagaagaaataacaactacaataataacaataattattatcagaatagggatggtaacagaagaggtggtagaagaaactatcaaaactcaggtaacagaagggattacaacaacaacaataataataataataataataataacaatactcacagccataacaatgcaggatctcgtcgttataatattcaaaatagatcacaatacgatgcatcatccaatccacagctttcgtattcgcaggcgtcaaacaatagtaatcaaactccacaattttgatttaacctcttttctcagcatttaattcttaagtatttgtgtgtctacatggttacatattcaatcacttttattgcggttaaagagactattttgttggcttggacggtcaaaagtctataaaaacatctgtttcgattgcattcgatgcgatatcctaaacctttttctcgttactcctttcacacttttgagatttaaaactgaatttgggttatgaaattaaaagaactacctattaattatgattcagagttagtgaaccttaagttcaaagcagtatatcagtgctttatatattaagagtatgtgagcatgggtaccgtggaaaagatcaaatgttgttattttttaaattactctatacaaaaatgcttggtttagaaagtccatgctagatatgcagtattatataggagaaatatgagactcctgaagagagccggactttttttttttggcctcactttaaatataagaggcgaacttatttagccttgttatattcattcagcttaccgatgaaccacaatgagcttaggtaacttaaagatccaaatgctgtccagcagagaatgttgaataacgtactataacagacaaataggaaagatgagatgaaatctctgtatctggcaacaaaaatcaaatacaaaatagagtacgcttccatataccatgcaactgcaccacccatatgaaatgccttccatctccatgaatgacatgcttctagaacccttcctataacgttgtcccatttgaaattcaaagaatcattaccatagtttagatgaatgtaacaaccaataatggatagaaggcagatacatatgcaaacgataacaatattactcaaaaggaatccgtataagtaatacagagtagtcttttgtagccaaagtgatttgtaagcaaataacaactccacgtatattagagcaaatggaataagtccaaaggtgagagtgatcgcaataggattttttaagacgaacggaatagagttcttactctcaacgtacaaaggcctagtgtcatgtttgttcacttctgccaatgcaaagctattaagcaaagtatttgtggagttaacttttaaaaacctatcggcacatttcccaccaatgattgatattggaacgcaaacaatgaaataagcaccaaatagtaatgcaacggtaccatggggtaaagtatttgcagcattattggccttaagtatgtaattcaataacaaaacgataaccaaagtaattcccggtagagttgatccgaatatgattgaattgaccaatttatgttgagacatttgcccctcaagtagagcaccgatgaaagatgatgtaaaactaccactgataaataggaatactgcgcaggtgagtacagagctgccaatacgatgggtatgattcaatgaacaagaaataatcaaagttccaagagtggtgaaaaggaaatgaatacccatagaaacgagcaaattcaactgaaagaataaaggaactctagccttcgaccattccgcagctagttgagtggtaatcgaaccatcagtttcctgtcttttcaaaatggctatgacgatcaaaagcaaacatgaagtgacaattataccattagcgaaagtaatccaatggaattgatttgaagtcgattcctttaactctccaccattaatgaagaaattccatctgtttttccaatccactttgaaatcttctctccaatacacggcataagtgaaggagataaactcaatatcctcattagttgggtcgatcttatagggagtataatccttggaggcgccaggacagtgatgatctgaaacggatttcggatagacctcaaacccaacaatggtatttttgccctgatcgatggtatgataacgaattacaatcatgacatggttattaatataggcctcatcagtttctggatcgtattgacccagtgggaaccccgatgaatagtattttttcttatctttggtgttaagatacgtggtagcacctggtaaatcatcatcggccaaccattggacgacgtaattctgtttaattaattcataggcttgtttcttcccctcaccgttagttttcctatcacataatcgcacacaatcctcgtctttaccgaacgtcagctgatagtccgattgccatttcttgttcccgtataatatgtcactgaaagtcaagggtaaaggtttcatgtcctgcgacggtggacaagtgaaatgtaagtcgtaatatccatacgagaaatgagttaagtcagattcgactttgttcacagtgatatcgaccttatcaccatactcatagaagttcggactcaatagtccgtactctttgaaaactccagtgtgctgctggtacgacgaagaaaatttgaatgggttggcatctggggaaggccgacgatgatttctcagccttggaagaacccatattagacttaaaagtaccagtaaactgactagaaccgatcttgatttcagtttcataacaagagtttagtggtggctgcgtgtgttaatggtttatgaactaaagcgaaagacagaaataaatgaggaacagtatgaataattgtgttaaggaaatataatagtttaatgtcacacacaaacacggagggcggataccagtgttcttcgatcaaaagaaaaaaaccccaggaaaattattaaccaaaaccaaaacaaaaccaaaaccaggacagtagtataatacagatatatatatatatatatatatatatatatcctatcaaaaacctcagagtgaagtcttgtttaccatttaaactttctcctctactcttttccctttttgcctgagatatgctttaaatatgaaaagctcatctcgaagaatagaaaatcgacaaggaaaaattctgaaaaatcgttttttttcttctggaaaaggaatcattatcctgaatagttagtacacggcagcgataagatggatatatatatctacgtacattactctccacgtatggggtctatattaacgtaactgtattaatatccactctacacattctgtaagctattcgtaaacattaattatataatatgttaatctgcccttgtgctgtctctcgccttcttttatttagtcaggctgagtgagacaatatatcctctgtgactatctaaaaaaaaacagtttcctctgtgctggccagtgtcttcttgttccagaccctttctgcacataaagctctgtttttgttttccgtttgcctttccttaaagcagatcaagaatcgattcaaaaattcgagatatacaatacgtggtgcatgggtgccagaggacaatacacatgttagcgtaatgaccgggtaacaacttctactgaggctcaaaaaagcacatcacgtgactgtaattattattgttatcattatgtcaggataaatttcaaatctagaaatcatattgtttttgtatacatagatgagggagaggtgcaatgtatgtagtgcactgcaaatttatcaagagagaacttaagaagtgctgttggtttctttaagttaaccaacccatgctattccattctgtgcggcagaatgctggtggaaatgtgcctgctcatgatagtttaggtggtcacaatcaagaaattatggatgcatcagtcttcaacggcctgccgtctgcaacctccgcagcagatgcagcagcaacagcagcagctgcctctgcttcaaattatgttgattcatcgaatctctcacatctttcagagaaatttaaaagacttgaaactctaatctcggatcatttatcacagttgaacatagaatccgccgttttcgtctcagagttgttatttgcggaatgctcgaatctggacgaatcatctcaggaaagagcgcttgcgaattacttttactctctatccctgtacttgaacaatgactttcatactgctatgcatgtttcctctgaaagaagacatgataatcttgcatgtgcctacgtatactctcgatgttgtttgaaattgaagaagaattattcagacgctttggattgtctattatcattacagtcctgttgggacacctgtctatcccattttgggtatccgaagaaatcaacaatctgtctcttagtagggaagttattcaaattattggatcacgaatctaagagtgaaactttcctcagatcttccttggatgggaatccttatctctgggaagcgagcacagaactttgtgttcttcgttcaagtttggttcttacggtattcaaatcccagaagaatgcgcctacacgctcgcaatcatctgcagcaatgatgacggtaccacctccaaactgtagtatggattccagatctaggaataagcctcaaactccatttaaagctccatccagaaacagacaaaacctttccaactcccaaactacatccttattatcggcttctaacgttggtgtatccatttctcctcatttctttaaaaaacacacaaggtttactacaacaccaactactgcaacttcaagtgcaaatgtaaccactacaaacacatcttctatcgatactaaacatctcggaactacaacaccatcgaaactgtcaggaacagattcccaaaccaagttgttaaggtctcccatggataaaaaaattatgaccaacaactcatatcagatgccaaacattagcacttttgactcaaatttggatgaacttttctccaacttcatccatatagaatattgcaagtcaaggtatgattcattcaaagccatccgcatgatgcaaaatcgcattccactacagatagcggtgtctatgccttggtgtttatccacattgggtaagctacattttgaattagttaattatgaaatggctaaatcttacttcacgaaattaagaactttacaacctacgcggtttcaagatatggacaccttctcaaccgttttatggcatttgcaagacaaaacacacttatccgctttatgcgcggagctattaacgttggataagtataaccccattgcctggtgcagcatggggaatcttcattcgttaaataaagatcacgacgaagccattactgctttcggaaaggcaattcaattggacccattctttgcttacgcttacactttacaagggcacgagtattctaataatgatgcattcgacaatgcaaaatcttgcttccgtaaagctttaactatcgaaaaaactcattacaatgcactttacggacttggaatgtgttgtgtcaaacttggaaagtttgaagaagcactattattcttcgagaaggcaagagccttgaatccggtcaatgtcattttgaattgttgctgcggcgttgcgttagaaagattacagcagccagagagagctttgaacttctacgaattagcaactgagttacaaccaaactcgtctttagcattgttcaagaaatcacaacttctattgaacatgggacagtattcttctgcgctacataattttgaaagattagaatcacttacccctgatgaagctcatgtgcactttttgcttggtaacctgtaccaaattgtgggtaagaagcaagatgcaatgaatcaatatactattgcaatgaacctagaccctaaaggtagtcaattaataaaagaagccatggaaaaatgtcatgaacagggttgataaatctgttatatatcgttacaaaaaatctacttgaaccttcaaccaaattctttcacacaacgtgtttttacagttatctatatagccttcaaaaatagcgtctcccagtgtatatgagtgttctcagatgatttgaagattataatattaatgataataatacagatagacgaaggactaaagatctacataaaaaatactacacagtcgacgaatttctttggagaatgatcagtgaagatcaaatacgattactcatgaacttaggatccaggccaaaatattctcctccttgagttgatagtgttttcgaaccagtcgatgaatttccagtattagcagtcgtatttgaggttagctgaccagccattaaataaggactggttaatccagacgtgatagtcgtattatgcgtaatacttggcgaggaaatattagcaaaatcttcagaactttgagtttgctcagctctttgttgatcccataagtcttcgtcatgttcattcagtgacctttgctgctctctcagtctagtttcttcacgcgcttgggacagcatttcctgagcttttgttaatgaaacggtaggcgtcgcacatgaactgataataggaactgaagtgtcaatgtcaatggtagctttgataagagctgctatccatgctctcatctcctctttggtgtctactgcgaagtaatgtacacgaggctgagtaaacgttagacctttcttggagccaggttgaggaggaaccaatttaaagcaataacgccctttaccagtgctagcagcatagagagaaacaaatttgtcatcttcttttgctggcaacactctatgagcggttatatcaatcaatccacgttctctattttcggttgtattggcaaagtacgacaatctggtaccatgcaacgtaaagaatctatttttccaaacacccatagcaccagtacccttcttactcatccaacctgaacaatctgcttcacgcatagcttcggatatagtaatactacggataccttccgtgaatgcggtagttctttgttttccgacatttttcgagctcgtaccgcgagctgttctcggtttagttgattcactcacagacctattttgattaacatccggttcgtataaagtatctttcgcgtcataaaatacatccgaggcaggttctttagcgctaacagagcgtctcttagcttcttttcgagtttgggggtttggaaggtctttaataggagatgtacttagcatcatcgaatgtctttgactaggcgtaccgttatcaatagtgttgaagggactaacaaatgaattcttcctgctatgagaaaccgacgtccttcttgatgttttagtatgtgcagtatctgtctcggcatgctcatccttctctttgaaaaatgacagcagagaagaattccttctatgccttctttctgagttggcttgggaaggttttctaccatgattggtagagtatgaggtagctctggaatgcccgtatacactagaagaaggtctttccatattaacaccagtttctgcatcagattcacgatcggcctgtttattttctgtattttccgacagcattgatatcctgttaaacagttcgacgaaggatccgcctgatttggttttgacatgtccggagtagactacactaccgcgattctctgaaacttgctcagttggacttgggtttcgttcgatagattgtgtttccttgaaatatgggtttggaaggctaggggtactagaagttggaccctgcttccttttaggaggaaattcgaactggtcgtgaatctcatcctccctcgatttttcctcctttgcctttgctttaccatctgccacttgttcatatatcgtgggatgtgcgtatttggaagtttgagcactggacattgcgttaggttgaggtgacaagaacctaccgccagagccagaactagaagcactaaccataggtgattttggaggctggactggtgatgggtatgaaggaggctttggggcacgtctaggcgacgcgaacacatcttctgaaatatccggagctttagtagtttcattagtaaatagcaaggatgctggtctaggtttctgagagcttttggtgtgtgttccagacgatggggttacgaagttctttggagttggagtcgaatttgaatttagttcctccatagattgtgatgttttccttaggtggcctcgatacgttggaatatcatggttagaaggtgaggttatcgttatcccagcattttgtttgaatgatgcagcgggcatcaaactattcctgttattggcagaagtgccattctgggtcgatatttccttcaaagcctcaatttctttaaagatctcaaaacgagttccaaacgagtttatctccaattccttcaaatgcgctaattctagttccaaaagaattgtacctgaaattttatgcttttggaacctcgatgctgattccacatcgaatcccaatgagatgaggtaagctgtaacctgttccggaacccaattcttcacattttctgggcgtaattcgttggttccagtagaagccaggctattacttttggtgaaatctaatgatgaacctgaaacaagtcttttcaacccaggtctttgatcataatcgatggaatcagttccagaggggaaagagtcaccccttaactcttcaagtgccttatctatatcactcattgtgcttttcattgatatgttcctatccacaggaacttttatcatgtctgagttgggcgctttgatattatcaaatttcctataagttgcgggttgtgcagtttctaacggctgaggggtaggtagctcactggtggacccatcctgggacgggtatgaaagatttgtattgcttccagaggcaaacggacttgcgattctcttggagctttttgccctcatcagggctggtttgcgttccatagcaatgacttgagtgaaaactttgggatacaggccttcttcttgtgttcttagattcttaccaaaataccaaccatcgttatacgacccatcatcggtgaccacttgaatcttgtctccaggcctcatatctagttcgtcatccatacgcttactgtactcggtgatacaaataaacaacgggaatgttttctgcggctgaaaccctgcacctaagggtgtttctccaacagatggcacgcctccactggtactccgtaaattagtggtatctatatgggttagcttaggtactttattagatgccatactgattttgtaggtatttctggaactcgaacggtatgatacggctgagatgctctaaatgaagtccagcgaattgttgagatgaaacgtataaactatgaggaaaatggaaaaaaaacaaaacgaaactgctctatttgcaccaatatataattcgtccacgttagcaaacctcttaccacaattttgagcactttcggtgaccagactatactacgacccttgatggttcttatgttttggttttttacgaagtgcaacttactttctaatgtttgtttctttaaaagtccacgtcttgcttccaaatttccattctgttcccaaatagcgaatgctcgttacccggacttgcgaccgatacctaacgactggttcttcatgttaccgttggtgattcatccttaattacgggtctaaaatacatagtactatcatttattgtccaactatatgaccgccatatcaagcgctgaggaaagctgagataacgtttttctgtataatttgtatttgaagtaaatgtccgtcatttaatatgaatgggattatgcatttgttgatgaaagagaaaatgatatcattctgtgaggtttggggcagctgtaggacctgaaatgtaagtttttgtacccacgagatgtattcgggcattcctgataagtcttgctttctgaagtgtgtcttgttattgttcaaaaaggtcgcatcagatgaattagtagaaaaagaactctttctattagatggggtattggtacctcgagatgagctggaattaacagaaccattcatatttgggattgatgacgattgtcggttaaaggggctaattgaacttgatgctctgcctttatggtctggattgttttcgcttgaaatgtgttgagaccaacgtgacatacctttcattttttggaaaatgcttctctttgacttcgtcgaagctatactcttgtttcccgaacttttcgcactaattatagatgctgaatcgcttccgttagcacttggtctgcgtttggagttcaatatagagcgatgaacagtctctctatcctgatatccgggtttcctcagcggtgggcccatagaaagactgggtgtcatcatttgcggctgaacaccactcagtaatgacgcctgtaccaacttgtttagatactgaagtgtacgtgcaataacttccacgaattgagagtcacttcgacgtgaataatcatcaagcgtttggctcaaagtcttgatcacattaatcttcaaaggaacgttctccacaggaaaatcactgccatggtgatatatccataggtcccacgtatatttatctaatgaaagatgcaacgataccactactggtaattcactttcgaaactggatcgtaacttctttaaagagttgacacacctgtgggcaacagataacttagattcttcagtgaaatcagccaattgtggggttagatcaaacacagaaagatagtcctcgaacttcttagtagcacagctggcactaaaatcattaatggagtctaaagtcggtgaaccaacttctatcagcttatgattacttcttcctgagatgtttgaactatctgagtatagcgatagaaacgattcactcatctgcggttcaagttgctttagaaaaccaagtaaacgaaatcaaaggctctgatgtcactcctacaacatacaactgacttcaacgccactagagtattgaatttgccaggctcatgtcgttgcgagaatgatagggttcatttcttacctttaacataaatagctttttgttgatgatgtgcttggtcaaaattgaaaaagtcaactatccgtcttcggtttcatagaacactatacaattaaggtacaagacgatggtaatgatataagatttgaaatttagacgtgtgccaagctacttttatcgattgataatgtcacagccaatctttctcttgtcttcatccatctgaacatcctgtaaatggaacgcttactacctctatgcggtaaatatatatgattgtataacttacatcgggttcaaaaatcactttttgactattagttagaaacagcggaacttttgctgtaggattgagaacaatgattaggatgaagaatgaaagtttaactgctgtgattactttcagtcttcggtacagtattgcatttgattaactatatttgccgcataatacataccattttttggacctctgaacctcctaacgtataagataaagttatcgtattcgattatattatgattagcatttcgaacaaatcgaaaagtaggagaccgaagttcttgctcacgttttccattacacagctcaccaatattccccaatcatccgggtattgttattgtaaatggcatttaaaagatggtactggtgcgtcaagttcaatcatcgaacaagaaggtcagaaaatcgataccaatcatcaaagcaaaggaactaccgagaggatatttgttaaaaaccatagagctaaatggaactatactgtggaacctccaatcaaattaaagttgcaagttgataagaataagacactctctaagaaaattctagttgtggaggtttattttgagttcttggaagaactgaataagaacgaacatccggagggaagatttagccatcataatcacgcttatacacagaaagtatccggaaagattcttttgggtaatgtgagcattgatgtcacaaatttcattgatcagaatggaactgagttccatgatcggttccttctacaaaaatcgaaagttaattcaatcctcagtatgtccatcaagatgcagttactcagagggaaatttgatgattttacgcttccgaatggagagcaactatcccagaaaattaaggcaaacttagagaatttcaccgataataattcagatacctcttctaatgtcacttcaccgctttcctctgtccacccacccgatagcgctggttctagggtatcaagtaccacgcataaaacatcacatttagcacatccaaagctgacgcatcagcctggggagacgttagcatcattgactatttctaacccagtagttgagaaactttatcagaaaacctttaagttcccatgggaccctagacccggtgaatatactcctcaagagtgtatcgaagatattctagatgggggaaacggatgggcaaagaacgaaaaggggataaatttgatagatttagagacattacagattaccgatttagtaaacgatgattatctattagcgtctttgcttgaccaacagggtatacactacaaaccaaacaacctaaattacagttgggatatattaacctcgaaatggagacaatcacaaagcggaaaatcaaggaacgattacttgaaagccaacatccagaactactatcaagaatgcaataaatcagggttggatgaatatgctgcagaaaaaatcaaggatgctaagagttggaaagtgaactatagcgccacggaagaaaaatcatcaaagccaaactcagacgcacaatctacccgttcaagtcatacccagttagaacagatctgatcaatattacgttatcgtgagctgattaacggtagttttcaatgcgagtaccaattggttgatagattaccttcgaattcttgtactttcagtgttgttattttttttttctaaggtaaaaaactggacgctctcgtccatagagctcttcggcagcctaatgatcttgatacagaagacttcataacaccaatatgatcgacgtttaggaaactctagcatctgtacgaggtttctctgaaatgaaacttttttttattgtgtcagttgtaatgtatgaaatgtgacgcaagtcggcatacaaaaaaaaaaattcatgataccaaaaggaaataatcctcgataaagtgaggttgaatgtgggaattcgagttagaaactctagatgtgaaatctctattggaactcagtatttatgacttttggaaacttttcaatgtacgaaaattttgtataaatacaggacaaagtacactgtcttgaacacttgaaacttgaataacgtattctcgtcttcaagaatgatcaaaggtctcatttagaaacgcctaataagtttaaacttacaaaatcacccagtgtcgataacaaaacttcaaggatctagctgtcatacatcaacaattgaaatgtccttagatacagaatcatttgaaactgctgaaaaagcaattgaggtagtcacaaaggaaatggtatctttgacaaattactcagccattggatcattaaccagtcagttatctcagaatgacactaagtcaggtggaattgaacagaaaaagttaccgttgaaaccaatattattgtgtctggctacttcttttgcagggtttatctttggctgggatgttggcacaattggtgggattacaaacatggtatcatttcaaaacttttttggtaccaactttgattcttcgagtaatacacactactttccaaaacttcttattggattaatcgtttccattttcaatatcagttgcgcacttggtggattatttctagtgaagattgctgatattaatggaagaaaaccaggtatttatgctgcaatcactatctattcgttgggaacattgattggctggacatgtggctcctcttggtggtatttcttcttcgcaaggttcatttcaggacttggtgttggtgctactgcggtgatgataccaatgtttatagccgaatctgctcccatcaacattcgtggtgccatggttgtgctctaccagttaatgatcactcttggaattttgctcggaaatgtcatcaactattgttgcagatccactttacacgaaacagataatgccacatggaagatccctgtaggattaggaaacgtctgggccgctatcgtcgcgctaggtgttcattttatgcctgaatcaccagtttttcttaccaagaggttaggaagcgctctcaaagctaaggcagcttttgcccatatgaacaatttggacgtagatgatccaattgtggatagtcatattaggaagatgatggaatcagctgacgcggaggtatctactcacaatgatatgaagaacagcaggtttgaattcatactcggtcaaccaagattaggttttagactatttattggtattatggtgatggcgtttcaacagctatccggtgcaaattacttcttctattatggtacaacacttttcaactctgtgggaattgaagacccatacttaacgtcgattttattgtcttctgtcaacttcatatctacctttttcggtatttatttagttgaaaagttaggcagaaaagcatgcttaattcttggttccgcgggtatgtttacctgtatgtccgtgtatgcgtcagtcggatcgttcgcacttaataagtcgcctcaaaactctggtgcgattatggttaccttcacgtgtgtttacatcatgttctttgcatgcacatcgggacctgtgtcctttgtcgtcatttcggagttgtttccaagcaggacaaaagcgatatccatggcagtgtgtacctcaatcaattggctttgcaacttcttcatttctttatgcacaccatatgtcactgataagataggcttcaagtttgggttcgtttttgctggttgtctatttgtctcattctggttcttcactttcttattgaaggaaactaagaacaaaactcctgaacaggttgacgcattgtattctattgacaagcaataggcaatggaccatacaggtatacttctacaaacaaagaaatttacaatgagctcaactgttcacataatctactgaagcctcccgatttctctgttcgagtgtgcgcttgaatcgctctccttcatataatttcactgtgtaaaacctattaactttctcattacgtatcattttacaagtgtctcaatggcattaaatttgtaattatttcagaagaattttaataacaaggcatttctgtctcccagccctgtgatatcttaatacttctatttactcttgtgttgttttatcgggctctcacttatcaatcaccgaagatgattcctgattcctcatatatttactcaacaagaaaaaaaggaagagatggcaatatgtaattgaaaatatgaaagcactcacatactatgattcaaaaatccagcaattggttgtaagccaaataaaccggtgatcgagagcactgagtattgttgctcaacgatgtttaaaagaggttcaaacagagctacttcgtcttctcaagggcagcaaccagaaaatcctccctctctgaaatatcagtcgtcaagttcacgatactcttttcatcgacagtacaacacaggttttggaacttcaccttttaggatatcacctaagtataaaccagatagccgcactcccttcagttttgatggtacgggaaatgttggaccagagagctctcttaatgaagaagaatcaaatgcaagatggagaccttctgaaagttcatttgacaaacgtagaactttccacggcgctaaatactctctgagtatcggaaaggaagtctcaagtatagataaaatcaattcaccggagagcagatccttgataatagcaggaaaaagccatttaggtatttacactttcgatgaagattctaagacgataactaatgtacatgatttcttacagacagcgaagacaaatactgggatcacgaagaacacttcatcgacactacggagaacaacaaaaaaaatttcaaccatatctgatgttaaagctggcttttacaatcacaaaaactatgtagcaatttgtggtacttcaacgtctgttgcgatttacgatattaataagacatcagcgatagacaatccagttgtaacatctctctcagaacatacaagatctatcaatagtgtggatttcaatatggtgcagacaagcttattaattagcggtggacaagatggatgcataaagatttgggatttgagatctcctaaaatctccaccactaggagtgatgtaagtatcaacaccgggtctgattccattagagacgtaaaatggatgccttcttacgagttttctaatgataccaatggtctttcaaacagacatttcaaatttgccagtgtgcatgactctggattattattgaagtttgatttgagacaaccaaaccaagctgaaaaaaagattaatgcacattctggtcccgccttatgtttgaattggcatccgcatcaggactacattattagtggtggaagagacggaaaatgttgcttgtggtatgtaggcgacaaatctaatcaagttggtaacattagtagtaccaacctcaattcaagtaatccagcaacgcataatttatcatcatcataccccttggggctatccaacacccttgcatttcctgagctcacaataaataccgctcgttccatgaataaacttaagtttcgtccaaaatatgagacgaatgtattcaattcattgattgggacttcatccatgggcgaagattcggatgtatctgtttattcgctagcaagaaaatatattcctaaaaacgttattgcttccagtgcaccttctgttggttttgtctggtgggatgacgacacgatattcaatatagacaagcaaaataccgttactgggtgggatatctctcatgaaccgactgtacttgataatttgccgaaaaacacaataaaatggagagatttggatggcgatggtattctgtttttggaccaaaaaccaggtgggtatttgtctcaagaagagacagttttgacaccaggtagtggagagaatcgcaagatgcctttcacacacagaatgagtagtgcaactgctaacagttttactggaggaaataatcctaacattacaagcaacacaagtagcagtgccgcaagtttctcaaaaaacccgacacttggcatgtctcaacttcaccagggcaacgtattaggtgaaaggtcaactatgtcaaagcatgcacaatccgttaacagcaaattttcgccttcggttaacagctcgccgtggaccaatccgtattcgtcccctcatcataactcaatcgtgtcaggatcggaatcggcattacatgcggttaatgattcctttctacaatctccatatttgataggattagactttccgcatattttgaacacaatacggaacactaggctcgcagaatttaacagaaaggtcgaaagtgcagctttattagaattaaagtcatctccaactgaagttttcaagtttttagcacgggaattgaagttttcgtataaatataacagtattgaaacaaaagacaacggccgagagcttgattcatcgagcacacatggctcagtggattctaaaacgaatttgatggaaaagttggggttatctgaaaataatacttggactcatttgatcaaatatacgaaatctcacgactctgacgaagtcatatcgaaaggcacagagcttaaaacaccagtttctgacaaaagtgctaatatcgaaaaatcagctacgaatcataaagctgaaaccaatcaggatgagaacagttcctgcatcaactcttcaaaccaggtaaaaaccaaaaacctcatcgaactgataactctatgtgataagaacgctgaaatttatatcatgcttgaggacttttcaaactacaaaatttggcttctaatgcgggattcattattatgggacttgaaagtcctaaccgagtcaatggctgttgacgtgacagctgaccaagaagtcaacgatcaatcgtccattgaccaaccttggaaaaaaaatgacagttttactagcttgaaagaggcaaggcaagcatctgttgctagtggctacagttcatatagtgctacggatctgagctcctcggtaaatacaaataatagacattctttcaacgaacccactcatctaacccaaactcctccagtatcacatttaaaggctcaacttcaaggttcaaaagaaactacgactatatcgagggctgactcgattcaaaattcgttacagaacgatatcatcgaaattagaaagctgcgtcaatctcatggagatagagcagaactagcaattgatgaagaggaagaaggagaagaaagagaggaacttacaaaaagggcgttcgaagaagatgaaaacaataaacaattcattaatatcccaagaagggaatcagggcctagcgctctcatgccgagtccttctcatgtttcctcacaaagcgaaattccttcaaatccggaaaaccatcaccagccacgtcggccgcggacatcttttatagactccttcatgtcacaattacgttctccaggatcgtcaaatgttgatgctgatagggaaagtactggtagcaaaaaatcttccatgccaagctttagctcttcggctgccacatttttgaatagcaagaaatcgcaaaacgcgaatcataataaattgaaaagcgcaactgaagtatcagatatattggaatctgaatttgctactcaaaaatcatggaacgggagcgttgcaaaaactacaactcaaatgtctggtattactgctcttatgaatgaaactaaaaaactggaaaatactattaccccaccttggtcatcaaggcgattaattcatcaattatacgaacagagtgttgcttcaggaaatatcctactaacgatggcaattttgttattatttcaagatatgtttcaacttgttgatacagagacagttaagaattctatagcggaatttaccgaattattgcaccggtacgagctatttgagattgcagcggagttgatgaaaaactgtccttacgaggatatttctagttcaagtgctggcttttcctccattcagttattctgtgataaatgcaataaacctttagttaacgaatcttccaaggagaaaataatcaaagaaagacttgaaggaaattcaagtgctatgtccaggtttggatactggtactgcgattcatgttctaagcgcaatactctctgttgcttctgcaataaaccaatgaagagcttggctatttctatgcttaactgtgggcatgagggtcacttcgagtgtttgaaaaaatggttttttgacgaaaacatggatgtatgcccattgggatgcccagcaatcttattctgaagtcaatttcctgttaattcggatcttttctatatcaagttatgtttttgtaagaactctttaacgacaacccaatacccatcttgtattatcgtgtcgttatgggaaccgatagggaactcaataaatcttttgcagctcgagggacatagtttatacaataatttcatatgagggggtgggacaatctcatctcttaaaccagcaagaaacaagaaaggtaaagtatcatcttgtatgttgacaatttcctgttcagaatcccagacttcatgacacatgaatgccacattcttcagcattgggaaaacgtatgggataactttgcgaatggacaggaaagtattttctaggataatggcatcgcagatatcggtaaattttctagcaagataaatggcattagcgccaccaagggacctcccataaagtattagcttccttgatttatgaaattcactgtttgtcaaatggtccatgacggtatctgcgtctatcttcaatcctctctccgatgggaaccctgttgataacccatatccacgataggaatacaaaaaaatggacaaattaaactcattatagagaaacctagcaacgggcaggaaatatcctatattccccgcattggggcaaagaacaagcatggttgcagtcgaattttcattccttatatcaaatgctttcaatagaacaccatccgaagtcgttaaagtgagatcttcataaggcaaaccgtattgatctggcgtatctacatggtctctagcaccttgtgcccaagatgggtatataagcttgttttggtacaaatatagagcgcccagtgaagcagaaacaatgacagctgcgcttccgagtaccattttcccaattttgtataaatgcatactagaaggaaaatgtcgctttggcaaaaagaaatatgttacgacaaactatcaccttgatcaataaactttctattcgatggatatagtgacagcagctacgttaatgaggtgcttgtcataattaaactccctttaatttacataataccgatatcctgctaaaacaagccagctacggtttgtatttcaattcgcatgcttcgagagcatgaaaaactccagaaaactcaatattacccgtcctttgaatataatcacgtgtattgacaactgattcatgttttacccggacaagtcgtaacgtcattaccctctcttagaagaaagaaaaaaaaaaatttgtagcagtgacagcatagtacaggcagcagctgcgaaggttttcaattttgttaactatgggaagttggcaaatggaagaaaaaatgaagttggattaacgaatgtgatatcaaagattggattgactctctgcgcatgtttaagatttttcgagtgttttttactcgtaaatgtatctgtataagaccagaggttacctgatcaattttgaacctgaaagacatcgatcttacgaccaaagaagaatatcatgtccgttgaagaagttactcaaaagacccaggatttaactgtggacgaagccaagccagctactgttttatctgatcctaaggaatttcaattgaagcatcctttgagtagcaaatggactttatggtatactaagccccctgtggatagttcagaatcgtggtctgatttattgcgtccagtgaccagtttggatactgtcgaagagttctgggctattcaaaatggtattccaaagccattcgatttgccaatcaaatctgattaccatttgttcagaaacgatatcagacctgaatgggaagatgaagccaactctgaaggtggtaagttgtcgtaccaattcaagaacaaaagacataacatcgatgatttgtggttgagaactctattggccgttattggtgaaaccatcgacgaagaagaatcagaaatcaacggttgcgtcttgaatgtcagaaaggctgttttcaagattgctttgtggactagaactaccaacttgaacgctttgactaacattgctaccaagtttaagcaagttctacaacttggtgaaggtgaaaagttggagttctacaatcacagaacttctaactcaggtcacgctcctccaaccgctctattgtaaattagcacatccctcctcatttcaacactcaataaattaaatcaacatttaccaaacactgtcgatgcaagggattatgagtatagttagaaatctgttttggacaggcctcatctgatcgctgtgaatcatctcaatttaccttgaccacatacccaaagggaaaaaaagcgtataaagggaatctttatggtgcatcacaatctcggtttgtgacagcacacttttggtattttaaaatggttggatttcactctttcgacatccatttcgtgtcctgctaatcataattccttcgactattattcgtaaactcttttttaaatgatatgtataaataattaacgtgtctgtttattctttatttaaagtcctctcctgtgtaattatcagtggattagtatctccacatttcattctgtcagtttagtttatgaatctaacgaaaagagatatatcccagaaatcatcatctattatttcttgcaaatagaacccgaaaatgacaaccaggtataataatattaaaatgcttcctttgaaataattcgatttcccctctgcatataagtaagtgaatagaaacactgacactactgatgcaagtaaatcccatctgggaaacaccatcgggaacattctatctctaatgctaatttgagtcaaatctttaccccaaacgtatagcatagagaatatgactaaggctggaatttgtaacaagcatacttgcaatgcataagcactaccgatttccattgaaagtgcaacattaccattgactgcgaaagaaatagcatttaaaaattctgtggtattaggaacaagagcaaaaatggtcaatcccaaaaattttggattcacagctggatattgttcgaggacctgatccacgcaatctactaatatttctgcaataatggcatacaagaaagttgcgcctaatagaatacatgttgatttcgttttagaccaatttggtgcgtcgtggccactactttgatcacaattattggtcgctttcgctgcattatttgctccagatgtgctacttgtgacaccaagaatattggaattggttttatttaatggagcaaaggaattttggctcatagacatgctagtagtcagctgactttgatcattgttcacatctttcgtttcagcaatcggtaattcccaaatcagtttagcgtgcgttcttaatgtgaaccacataccgataatatattgaaggaacaatgcaaccgtacagaatagtacaatgggtctaaggatagcagagtacattttgtcaaactttaattgaggctgtacaaaatgacatttctctccattttcattgcaaagtaaatcccactcaccatatatttcatacaacactgatggaataaacataactaccatcgagaaaattaacatcgcgcaagaaacaccggcactggcggggttataacgctgagtttttcttttgaaagcgccaccacacatggacataccaggtaataatagaacggcagctagaatagatccaatcaatgaaccttccactagtagacctttctcttgttgaagtgcgacacagtataagaaaatctcgacaatggtggagaaaaacgcattaattacagctgccacacccatcgaactctgagctgaaatagaagcaactgcttgtccgatgtaaaatgccaaaggtataatagacaataaacacaacatgaaaatagtagatccatcagttagccaagtgtcgatttgccagatatttttaattgcataaaagtcgaatatggtgaatataaccaaggcaatcaagttcatgaccataacgttagtaccatccactgtgaatttatagtagtgtaacccagcgcaacggaaggtgcataataagacattttggcctttgatatcttcgattggagtggttgccactgctgacgtagcactttttacgtcaatgattctcaaagccaaaggatgttttctgcaatgatacattaaattccacaagatattactcattggaatagtgaatacaaacaaccaagttgttagggacagcaacatcacaactggttgaacgacaatgtggaacatgaaataaaaaatgaatctgccaattgtccatttaccacgcccaaatagacgacgatgtaaatgtccgttttcttcgtcactttgatcgtcgtttgtgtcagttctctctgtaattataggtattgatccatacgaatcttgtctatggttattaatgttgtttcttgccgtgattatgttattgctgttattgcgagtggatgtgtcattattactaatgttggccctggcgttttggctggaagaaaagttattcgaattatttgtgctggcattattatcattgatagcttgtgattcatgaaaaaataaccgattgctataattggtaatccatttgtagaattgctgggcactgataccttcgtcctgatcttctacaagatattgcgcatctgatttcatcaatacaatctttccgaatggccagagtaaatagcgtcccaaccgataaaacactaaagaatactcgatcgcagatccagtgaatcctccaaagatcaatactaaacatgaagccattgtgaaaatcaaaaataaaaacagaccaacagtgaaagaccatattaaattagtgatttgaacaccaagggtaatgtttctgatttttgtttcatggatatcctcatctgcagcttgctgcactgatcttttcttcttataaagagccggtttccatatcctaataccaaacggatgtgttttattaatcgcttcttgtctttctcgtaacgtatacgattcaacagagctaatgcttcctgtttcgatatcctgaatattagaactttcactgtcgtcatcaataatcaaagtgtccaatggattctcgtcatagtcattttcgatatcatttttattcttttttttactgctattcggttcgttattatgagatgcagcggtaatagcatgcttatttccatcatgggtatttccactattcgatccatctcttgcatcctcatcgccatcataagtatcaccattttttctttgctcctcttgcaaaaccagatgtctgtctccatcatgaactattatcctatcattgtcttcactaacactgaaacgcgaaccaattctgtgcaatgtggggtcctgcttcgaagataaagtaccaactcttttcagcttcagtccatctttcactccttctaaataatggtaatcgcgttctaactcctcggcatcatcgtctacagaaaagatccgcttcgtaccctctgaagaattactctttaccggtttaattgactttttaggcatcgatacttcttatttccagatcccaggggttgaatcttaactatattagaggaactatatgagtccagttgctaaattagaaataaagctgaccaaaattaaggcaaaaataaagtacaacggtgcaaattctttgacttattaatacgacgccacaaataactggtccctgacctatttcttcgaaagctaaaatggtacaagacacattaaatacatcttttgatgtttttgaagtctgtaacttcttgatctgtgtcaatttttgcctgttgaaagggggatgaggaaaatgtaaacacggtcattctccagtcacgtgaaatctggtcccaaaacatgtatggtcgtgtgacaaagtgagacagctattgttaggcatccattgcaaaaaagtagttgtataacccagggaattacgatgatcctagtttggggccaatatcgttaatagaacgctgtatatctattgttgtacgtgaaataagtcttgtctatcctcaaaattcatatttcaggccgccaaaaaactatttcgagatttctggccggtattttcagaaacgtcaaatctcgaaacttacatttcttatgaatttaagccactaaataaatagtggttatttatatatgaacttgaacattttgcgaagattattattaagttgatgtaactttctctacccttttgaaggttgaaaagagacaatataagtggccagaagtagactagaagctagcttcacaatgagatatacatttactggattactacttcttttggtggcttcatttggtgttgaggctcagctgataacatctactcttacatcaatcaatgttgctggtgccactgtgacgcttgtaactgttattgattcagctacaatagcagcagcagcagccgctactgcagttactactactacccctacgacagctgccctagcagccggtgcaacaacggcatcgacatccactaccggatcaacaacaacgactacacctgtggcagcagcagcagcagctaccgataccgatacgacgtccgttgctactactacagctgctgtcgttgctaatgcagctgacactgcttcatcaaccacagcatcaaccacatctgcagcaacagccgcagcagctacaggcacaagaccagatccatccacatctatgacaccattgccaagcggtgtaggtactcctatcgattcatatgtcactttaactttcggaaccactagtaccacaactagtaaaagacaaccaaccagtatctgggtcactaagacaataagtggtgtcacaacagctttcgagactcctttctatcagaaattcagtagccaatacacggctgtgtcctctgcaagttctggtagcgttgggctaggtacactttctgggactgttggtgttgtaaaatctaagatagtaaccactatttccggtaatcatgccgtttactttgctcaatcatctgctactatgacttcgatgatattgaccgtgttaatgatgttcatttaaaaaccggatcaaaataaatttggaaaagacattttattgttttccatgtagtagcatatctcttcagatgattcaaaggttttactggcatctgatttagtaccaaacactaggggttataaattttataaattgttcacgttatcatataataaatatggatatactttaatttacaaaacatttgtctatacatttattgaaggatctcttatcatccagtttcgttgtcgattctagctgtatactttttcaacggctttttcaaaaatgttcaaacctttctccaacaagttgtcttcaatggtcaaagccggaacaaatctgactgttgtcttaccagcggtaataatcaaaagaccactgtctctagcagcatcaacaatttttgctggtgcctcgtcaaaatcgcaaccaatcattaaacccttccctctaatatctttgatatgctctgggaaacgctcttgtagctttctcaaacggttagtgataatctcacccttcttattaacttcatccaagaatttttgttcggcaatgacgttaacaacatagttaccgacagcagaacccaatgggttaccaccataagtggtaccatgatcaccaacttttagaatatcgtttaccttgtcattggtcacagtagcagcgatagggaatccattaccaagtgccttggctgtagtgaagatgtctggatgagcctcctttggcaagtatgaatgtgcccataacttgcctgaacgacctagaccacattggatttcatcgtaaatgacaataatatcgtgatcctcacaaattttctttaatccaactaaagtgtccaatgggattgggaacacaccaccttcaccttgaattggttccacaatcaacccagcagtcttttctttcaagctagaaacttgttgatccaatttggtcagctcatcgttaatatttaaaaattccactccgggaatcaaagaaccaaatggttcacgatattttggattactggtaacagacaaagcacccatggtacgaccatgaaaagagttttggaacgcaattataccttgcttcgatgggctttttaggataccgtatctcttggcgaatttcaatgcagcttcgttggcttcggtaccggaattacatagaaaaactctggatgcatcgtattgaccaccaaacgatttagtagcttccactagattttcactcaacttcagacattcctcattatagtacaagttagaagaatggatcagtttcttactttgtttgtacatgatctcagccacttccggattggcatgtcccaaagcagttactgcgataccagcagtgaaatcaatatattctttattgttaacatcatcataaagaatggcgttcttacctctagtcagaaccaaatgattaggtctggcataagtggttgcctggtatttttgtttatcgactaaagattgcaacaatcttttagaagtgtgtaattgacggataactctcattattgggttaaagtatggaaggaagccttttcgaccggttcaatttgattatctaatgtagcgtacaggatgcaggatactaagcagattccaaagtctagtaactaacactgcagtgccctttattatctattcagatcaacttaccgttaagtgatatggttagcgatgagatttttgaagaaacttcctaaatggaaatacttcacattgcagtatatataaagaaaaaaacagctaacggcatagatgcacataatgagtgagaaagaacaatacaatagagtcctgaagatatgaatcagaggtgaaaaccaggaacaatgagcgatgcaagcttcattgtataaagaggtaccctgtcaagagtgatcacgcattgtgtgtcatatccagtgccaattgatggtcttgtgttcgcttttttttatgagtcactcttactgatctctcaataggatggtgcatcttatcaaaaaattgctctctgattaggaattaattccgtgttcgaaccccacttggaccactttttgaaaagacaatgatgcaatgttagctatatgataatattagtccgtatctatataatgatgtgtttaaagggtaccgggctataagtatctcttgcataggtagaaacaccatttttcgaatttgtatctccatttaaacaaaatgtttctgttgtgtagattgacttctatatcgttctgatcgaatgtgaacttcccactgcgcaatagttgttgttggaatgcaattatgatgaaattgaaatagaatctgactgctagtggaactaaagttagcaatatgatgaggaaaaattcatagccgctagaagcactcttagaagtatctactttagttgagatcgtggatgtggttccctcatgagctggtccaagtgcggttcccgcgctcttcaagtccgtaacgtcagtggagccctcctggctgaaccacacagcagtgaaccataagcagtaaatgcaactaacaattgtgtccacactgaacacaaaagtaaccgtggacattaagaggatattgggcttataaacttgtcttattcctgaaatgaataccactagacagaaaattgaccagatgtaaaaagtccattgcacaaagtctaacgggtgtccagtgaaaagtgcaagaacaccatacatcccgctgaatttgttgaaggttagcacaccaagtgcaacctcaacacctatgtacaagggataagacaggaatgtctaaagggcaatgtcatctgttagtacatattactggtatcaaaaaaaaaccatgcatcaaacgatcatgtaaaaacgtctttcaactgcggttaaatacccaaaagaaacatacttgtggcaaatgaaccatatttgattgctgctgcataggagtataataaggacaaaccctgacgttaaagcaagttggtttcttccacttacacaggtagacctttcaattcatctactgagcgttttagaatgtttacaactatttcctctattgaaaagcaattcgcgatcctgtctagagcatcgtgaaaaaaaaacgtaggaaaaaaaaaagtacgctactttactttaatggtgtacaagatgagcgatgaggttggaatagtggttatttacagaacaatatacgccgttcagctcctgtgtattgtcaaattagtaaatcagaaagcagaagttatctatagttggactacgaatgatgaatattgacgataagctggaaaaactgaatttagccaaccgtgatgagcatgtcaacactcagatcctagagaggtatgccaatagcatcaaaacagatgagttatcattaactaggggtaaaaccagcaaagataaggcgaatagggccactgtagagaatgttttagacccacgtacgatgaggtttttgaaatccatgatgaacaggggaatattatcagcatttaatggttgtttgagtacaggtaaagaagcaaacgtgtaccatgcgtttgctggtaatcatgaggagagacatctgctggtagagggacatgatgatacaataggagccccacaaaatattgaatcaacaaaacaaaaagctctaactgccgaatctgaggatgccacatccacttcaactgccactgatgaaccaaaaaataagaaggaatacgcggtgaagatttacaagacatctatcttggtttttaaggatcgtgaaagatacgttgatggtgaatttagattcagaaattcgagatctcaacataatcctcgtaagatgatcaaaatttgggctgaaaaggaatttagaaacttgaagagaatataccaaagcggtgtcataccttgtccaaaaccaatagaagttagatcaaacgttttagtcatggaatttttaaatagaggagatggtttcgcatctccgaggcttaaagatcatccttacaaagatagagaagaaattaaacattactacaatttaatgatagcgtacatgagactgttatatcaggtatgtcgcttagttcatgcagacttgagtgagtataatagtattgtacatgaggataagctttatattattgatgtttcgcaatccgtacaaccagaacatcctatgtctctagatttcctaagaatggatattaagaatgttaactcatatttccaaaaattgggaattgacattttccctgaacgggtgatcttccagttcatcatcagtgaggtcttagacaaattcaagggtgattacagatcaagcgatgatctagaaacatatgttgccgacaatttacctctaaagttgactgatgaagacgaagctgaagatgaagtgttcagatctttacatttgataagaaatttgggtggtttagaggaaagagattttgatagattcactgatggtaaatttgacctactgaaatcattaattgctaatgaaaacaggaaatattccgaaaatttcacagcatcggagcaatatgaactctcttcttctgatgacgaggaagatgacgtagatggtgatgatctccctaacctcgtaacggatatcaatgaagatgacatagctggatcagatgaagatgatgatagtgatgaaactaacgatagttctgatggtgatggatgggtctccgataaagacactccactgaaaggaaaaaagtacgaagataaagatgctaaaaaacaacgtaagcaagaaacaaaagaggccaaacgtgaaaagaggaagaccaaagtaaaaaaacacgttaagaaaaagctcattaacaagacgaaaagcaagaaatgatcaatttaaaaattctatgcaatttcaaatatttaatatttacttagcgattttaaatagatccaccgctttgatgttgccctacaagacctgccatttccaataatgcacgatcttctcccatgctttgtaagttgatcttttgccttcttttggcttcggcctcttcccattgccattgctttacttgctcttcgagctctttttctcctccgcatccccacacttctacatcttggattatgaatcggtattcgaacgaattccgttcttctccacgtccacttattagacggccaggcttaaaactcccacctgctcccaaatgtctaaatataccgaactcgagagatgaatcaatagtaagtgaaacatttcctgggaagtattttttaccgttagctttgatgataggttgagagctaccaatacctatacctcccccaacagtgttgaaatatacgtttcctgtcttgaatgggtccgcatcgaagatctcttgtcttggatgaagttggataatttttgtagacgaatcaccaaacaaatctttatttgatactttccatgggtcgcgaatacaaacagcaaataacaattttcgttttttcttacttaacgtatccaaatgttgatcttcactttttaacttaccatattcttgcagaaagtttctataccttggatttttcacggcataagcatcgccatcttcatcgtcctcgtcacgaattctcataccctctacgaataatatcgtaggtgccatccacttgaagaccttagattggaaagatctcatagaaaagcccgattcccttccaacatataatttctggaacctggagaaaacaatctccttcggtaaaaaagttgctaactgcgatagctcagattcatttacaattttagtaggatttgagattggttgaagaacgtccgcgtctacgagatctctatccatataaagaacatgttccattagcattttcaagggatttaaaagattaggggcaacatcattaacggccatggaaaattgggtatatgtgattgatgaatccaaacagtctgacattgatataatctcggggttcattgtgcgtacaatattaagagcttgatgtttgaagtcctctaagctcttcgccaaaacatcattgtcaattttacaattgttcaaaatgcagcagcgagaaagagccaatatcaatgccaaaaagtgaagaagattatttgcatttactttcaattcatcaaaatcagttccgttataagatctaatgacccctttccaatccttacaatcagatagagccgaagagtccatgagaggttcagctttgatattcttttccaaagagagcgtaataaatagcattttcaaatcattgtactttttccaatcggtgtacttgatggctctttccttgactagtaatagcgtggcctttaacaaggttttgaaagtaaccttttcgtaggaatcttgtagaagtggaaagttcgctagagtatgaaacatattcataaataccgataacattacagcactatctttcgggatataatacattctgctaatatctgaaacctcgacataatcgtttagttctttgccctcaggaatattgttcttgaacgaaattagttcagcagtagttaattgttttaagcatctgtcattgaaaaaatccattaaagattctccttttagtttagattcatttgtcctagcattttcatgctctttagaagttgattggcccattttgcatacattattgtgacagttatccttatggctttccttcttagcaccttttcagagtatgtgtaagagtaaatccttaaatataccttaatgtaaaaagaggagactacgtactaacacaaagaaacaaaatgttaacatataagaaaatggttgggagcaagaaattcctgacaaggtagactagagccagcctgtatacatggtatatgaaagtgaaaacatatagttcttccgacctgtaattgctctttacggctcgattacatctgtatttggctcttttcacgtgaccgaagttcaccaacattattttttttctttttgattttagagttttttttttttcttttcaaattatgccaacctcatctcatctcatctcatcgacacctactagttaatcagtaagttcaagattttaaaccttatgcacatctagtttcggtatcgtgccaacgaaatcaactaagtgaacaatttagagtcatattagtatactaaaggatgaattcgaaaggggagaaaaaggagaagatcactgaagatccaagattttctgggattcataatgatcctaagtttaggtcaactaaatccaagaactttaagatcaaattggatgatagattcagtaaacaagatctagaagtcagacgtaaagcaaaagttgataaatatggtagaaaaattgtggatgctaacaaggatgtaaaggattttgatcgttattttaccaaggaaaagccggaggacaaggaggatgagtctaattcatccgaaagcagcgatgatcaagaagctgaagctgctgttcatgcaaaatctgttgatagagctcgtggtgaacctcctgctgattacgtttcttcttctgatgaagagtcctcctctgaatccgaagaagaatctggggacagtgacattgaatcagaagaaatcgaactagaagagtccaaacctgctagtggaaatgccacaaatacgttggctgtagtgaacctggattgggatcatgtcaaatctgctgatttgtttgtcacatttaagtctttcgtgcctaagggaggagagattcaaaaaattgccatatatccaagtgaatttggtaaagaaaggatgcaacgtgaagagatcgaaggtcctccaaaagaattattccagtcaaagaaatccaagaagaatgataaagatgatgatgagattaatgtcgaatcaatttatgaggaaggagacgcagaggactatgattctaaagcacttcgtcgttaccaattggaacgtctaagatactattatgccgtggtttactgcagcgacattaggacagccgaatcaatctatcaaaactgtgatggcacagaatatgaatctacagccaatgtctttgatttaaggtatgtgcctgatggtatggaaatggatgatgatcctcgtgatgaatgtacctcgcttccaaaaaattacaagccggcacaattcagtacagatgcccttcagcattccaaggtaaagcttacatgggatgaaactcctgcagaccgtgtggaaatatctaaaagagcattcactcaaaaagaaattgaagaaatggactttaaagcttatttagcctccgatagtgaagaatctgaagttgagcatgatgatcaagttaaaaataaactcaaggctttagtaatggattccgtaaaagtggggcaaaagtcactatttgatcaaaaggaagatgaagacgataatgaggctgatatggaaataactttcactccaggcctggatgagtctggccaacaagataccaatgataacgaagaggaaagcaccattgataagattagacgtaaagaaaaagaaagacgtaagaagagaaaggacagagtcaaggagcttaagaaggaatcagaagccaaattaaaggagaaccttaagaagaagaaagatacttctcacagcatcgatgacgataagaaaaagggagagttagagctcttaatgctagatgaaaatgagggtgaatcaacaattaacaacaaggcacacttcaacatgaatgagattctcaaatctgagaaggaaaaatccaaaaaggccaagtatcaaaacaaggagaagattgtggatgatgaattcactccagacgttaatgatccaagatttaaagaggtctttgaagatcacgatttcgcgattgatcctactcaaccagagttcaagaagacaccagctatggagaagattttaaaggaacgtacagtacgttcaagcaaaaaatctaggggcaaaaagcgtaaccacgaaattgcaaatactgaacatagtaaagacataaataagatcggcggtttagttgaaaaacttaaggccaagaacaaaagaacaaaacactaatttgcaaacttgtggacactttatatcaacccaaagacgtccacatcttatatgtatatattcagcatttgattaaagcataaatacatcatttcacttaatcatgcgactgtatcatggcatggtctgtaactttaagtcatttccttatttatccagatttgtacgtcatattctgtgtgtgaacaaaaagaaaaagtgcacattatcacattatatgaaataggttcatctttctaaagattatctaaaattgtaggtaatacacggacaaaccgataaacttactagatagactctgccactgccataatatccagggaataatggggctggtacagggttatgaaagtgagagtagtgatgatggctcatctgtagctgtgcctaagagatcgttaaaaacatcaaaggctgaattgaagtccaaaagacttaggaggaacgggaaaggaccatgggcaaaatggcaaggatctagtgacgatgagatcgaacaattatcaaaggattcaaatgcttctaattccttagatttaggtggtgatgaggatgcagtggcatcacaatcacttgaaagaacgaaatttgtaggcagtactgaaaaagactatctgggaagatgcattttacaccccccagtagatattccattagaattcaagaaagaaccactatcattcaggtgcttccttccgaaaaccaagatagcagaatactatgggcataagaatggtactacatcattacgattcataccgaaaacaggacatctcttactttcaggcggtaacgacaacataataaaactatgggacttttatcatgagagagaactattaagaacgtatgaaggtcactctatgactataaaggatttgaactttacagataatggacattcttttgccagtgcatcatttgataaatgggttaagatctggaacaccgaaaaaggtataattgataaaagattgcgtttcaactctgtaccgaactgtattacattccacccaaaagacaagaaccaactagtggtaggattatccaactccgaaatacggcactatgacttgaggctatcagaaaaccatggggaagtacagaaatatgatcatcatcagggttctattttggcactaaagtacttccctgatggtaagaagttaatctcgtcgtcagaagataaaacggtcagaatttgggagaaccgaatcaatattcctattaaacaaatcagtggcacagcacaacattctatgccatggatcgatattaatccacagggtcagtctttctgtacacaaagtatggacaacaccatctatacgtactcaatgttaccaaagtataaaagacacccaaacaagacattcaaaggtcataatactacaggttatggtattcattttgcattttctcctgatggccaatacattgcatctggagactctaaaggtcagacgttcatctgggattggaaaactaccaaattgttaaagaaatttaagccattttcaaataacctgccagtaacctgtattgaatggaatcctcaagagacaagtaagttatgttgcgctggtaataccggaaaaattgccattctggactaatgaagaattgagattctttgagacattattcttggtttcggcacaaccttcgataaggttatgtagatatacttaatgattacatataaatcatgcataaaaggaaacggatttagactttcttgcctgtacttcaccgatagcctcaacgaaatcttcgtgcttgattgttgattgagcgtttcttaatgcgatcataccagcttcgacactaacggctttcaattgagcaccattgaattcatctgtagatctagcgagttcttgccaattgatagaatcatcagttgtcatttttctggaatgaatctgtagaatttgagctcttgcatcttctgtagggagtgggaattctatttttctatcaagtctaccagatcttaataaggccggatctagaacatcaacacgattggtagcagccaacaccttaacccgatcatcagagccaaatccatccaattgatttagcaactctaacattgttctttgtacttctctatcaccagatttttcggaatcgaaacgttttgtaccaatggcatctaattcatcgatgaaaatgatagtaggtgccttttccttagctaatgcaaatgcgtcacgtaccaactttgcaccttcaccaatgtacatttgaacaagctgaggtgcagctagctttaagaaagtggcatttgtttgagcggcacaggccctagcaagaagggtcttacctgtacctggagggccgtacatcaaagcaccctttggagccttaatacccatatctttgaatttttcaccttgcttcattggtagaacaatagcctccactaattcctctatttgtttatctaatccacccacatccgaatatgtttctgttggtttttcatcaacttccatagctttgacacgagaatcaaactccgatggtaatgtatccaaaatcaaatatgaatctttatttacaccaactaaatcatttggtttaagctttactggatccactaatcctaccataggtaggaacaccgtttgtctggaagaagtcttgattacagcagctttacccttagcggcattatctaaattgacattaccgccttgagtgtcaatctcgttggaatcctgtaattcatccatatccataatttcaacaacattcgccactaaatacggtaattgtttgttattcttgatcttttcttgattatccttaatcttctctagcatctgactgttttcatgagacaaacgttgtagttcggatctgaatatcctaatttcgttatctagcaacttcgcacgagtagttagttcggaagctgatagattgaaaaattcttgatcgatatcatcatcatctggctgactttggttattcaattcttctaacgtagacatcacttattcgtgtttatatgtatgtctattttctttgccaatctcaaacaatgtttcctcaatataatacctataaaaacgttgtgcttttccagctcgcttctctttacaagggttttggtaccaattgcacagtctagtattaatcacagacagatggactaccgtgttcttctcacttttaaatcgtcttttgccaccagaacctggtatttcagaacatatacattgattaaatgaatttgttaagctttaaagatcccattgaaaaaaagggcagaaattaaaatatccgggtaacgaaatatttatttcattaaaatcgatatactatttacttataatatacgtatagtttagtggtatagatctatggtacagtggtgggtgtggtaataataatgatatcaaatcattaattctctagctcctttttcaattccttggtgaaatcatcctctacttcgatatcgtcccagtcttcagcccaaaggtttgaatcttttgttagatcttgtgaaacaggttgcgatggccaagaatcagctgggaaatcctcgaattcatcgtcatcctcaagagaagattttcttggttctttatttgacatcttttcgcttgtacaacgctgatgtatcaggtcaaagtgtatatcaggggctgtatatatcttgagtgaatctatatgtagtattacttataaggtttgccactatttcagacctttttgtagcttttggatgattgtttattggtccgggtaatgaaacggctttgacagcataaaagacaggacacattgaggccaaacgcaaagggtggtaaatcgttgtgcagagtgtattaatgcatcgcctcagtacaatatatcccaaaaattagggaccgtcaaatcacctagctctctgtaatccatgtgttagccttttctatgatttatagttgtcacccacacaccacacgtttaatattcaattgtaaaagaaaaaaagtttgaaaaaattctggatcagaagaattggaaagaaatccacgatgagcttaaagctgtctaattcaattgattcaatgaggctacatatttgatattctattcatccggttgattttgttggcagtcagtgtggcaaatcaatttttactcaatcttgctagagatatcaaagtggaattatcacaccagtttgaggcttttgtgttgtctgtctctgctatacttgcccattagttttctagtttcatttcggacaagtgatgaaagagactgtaattgacatcgctcccaagaagattaaagggatcagcttctcagcgctgagtgcagccgatatcgtttctcaatctgaagttgagatctctacaagggatttatttgatcttgataatggtagatcagcgaaggagggcggtgcgttagaccccagaatgggtgtttcttcttcgcaggcagagtgtactacgtgtcacggtaatttagcttcatgccacggtcatttcggtcatatcaaattggcgcttcctgtgttccatgttggttattttaaggctacgattcaaatattacaaagtgtctgcaaaggatgcggcgccctgttactttcagaagaagacaaacgtaagttcttaacggagttacgtcgtccaggtatggataacttgagaagaatgaacatcttaaagaaaatcctagatcagtgtaaaaaacagagacgctgttttgaatgtggtgaattgaacggtgtagttaaaaaagcagcggcaggttctgggtctgctgctttgaaaatcattcatgatactttccgctgggttggtaagaaatctgcaccagagaaggaacaatggattggagattggaaacaagtcttggaaaacaatcctgaattggaacgttatgtgaaaagatgtatggacgatttaaatccattgaaagtattgaatctattcaaacagattaaaccgaatgactgtgaattgttaggtatcgattccaccagcaaatcaggaagaccggaaacgtatatatggagatatctacctgctcctccagtttgtattcgtccctctgttatgatgcaagattcaccagcttcgaacgaagatgatctaacggtaaaactaacggaaattgtatggacttcgtctttgattaaagccggcttagaaaagggtatatcaattaataacatgatggaacaatgggattatttgcagcttgccgtagcgatgtatattaactccgattcagttaatccatctatgcttccgggctcttcaggaactaaatcaaaacccatcagaggcttttgtcaaagattgaagggtaaacagggtagatttagaggtaatttatctggtaagcgtgttgatttttcaggtagaactgtcatctctccggatcctaatctatctattgacgaagttgccgtccctgatagagtggctaaaattcttacttatccagaaaaggtcactcgttacaataagcataaacttcaacagttggttattaatggtcccaaggtacaccctggtgcaaattatttattaaagaaaaatgaagatgctagacggaacttacgttacggtgatagggttaaactagctaaacaactacaatatggggacgttgttgaaaggcatatcgaagatggtgatgtggtcctatttaacagacaaccttctttgcatagattatctattttgtcgcattatgctaagattcgtccttggagaacattcagattaaatgagtgtgtttgtacaccatacaatgcggattttgatggtgatgaaatgaatttacatgttccgcaaacagaagaagctcgtgccgaagcaataaatttgatgggtgtcaaaaataatttattgacaccaaaatctggtgaaccgatcattgcagcaactcaagatttcataactggttcatacttaatttcccataaagattctttctttgaccgtgcgcaattaacacaactattatctatgatgtccgacagtaatcttcagtttgatattcctccgccatctatcatgaaacctcactatttatggacaggaaaacaagtcttttcattattaataaaacctagcaggaagtctcctgtagtcatcaacctggatgctaaaaacaaagtttacctgccgcctcctaagaaagaatatccaaacgaaatgtcacagaatgatggttttgtattaatcagagggtccaatattctttcgggagtgatggataaatcggttcttggtgatggtaaaaaacattctgtattctacacaattttgagagattatggtccaaatgaggccgcacaagccatgaatagaatggctaagctttgtgccagatatttgggtaatagagggttttctattggtatcaatgatgtcacaccgggaagcgatttaaaacaaaagaaggaacaaatggttgaaagtgcatacgctaaatgtgacgaattgattgaccttttcaataaaggtaaattggaaactcaaccgggttgtaatgaagagcaaacattggaagccaagattggtggtctcttatcgaaagtcagagaagaagtcggtgaagtgtgtatcagagaactagacaacttgaatgctccgttgattatggcaacttgtggttccaagggttccactttgaacgtgtcgcagatggttgcagtcgtcggtcaacagattatttctggtaatcgtgttccggatggtttccaagatcgttcattgccccacttccctaagaactctaaaactcctcagtcgaaaggttttgttagaaattctttcttttcaggcctttctcccccagaattcttattccacgcaatttcaggtcgtgaaggtcttgtggatactgctgttaaaacagctgaaactggttatatgtcccgtagattgatgaaatcattggaagatttgtcttgtcaatatgataatactgttagaacgtcttccaatggtattgttcaatttacatatggtggggatggtttagatccgttggatatggaaggtaacgcacaaccagtgaatttcaacaggtcatggacacatgcgaataacctaaccttaaatgacaattctcctggtctgcttccttatcagattattgctgaaaccaatgtcattctacaaccacttgaaaacaaattgaaaagatacgacaatattgggcaggaacttagaaaggaagacgagcataaggacgaatatatcgatcaatttgacgctgaaagatccttctatcaatcgttacgtgaatttatgacggaaaaggccctgactcttgctagtttgagaggagaaagaggcttgaaggagcttgtagacgaaccagctgaagagctacgggagttcaactgggatgaaaacgttccagcttctataaccattgcgttgaaccaactttgtaagatatcgaagattctcgttcaaaagtttttgagcatagcgatttcaaagtaccacagagcaagagtggaaccaggtacagcagtcggtgcaattggtgcacaatctataggtgagcctggtactcaaatgacattaaaaactttccattttgctggtgttgcttctatgaatgtcacccttggtgttccacgtatcaaagaaattatcaacgcttccaaagttatttctacgcccattatcaatgcagttcttgttaatgataacgacgaaagagccgcaagagtggttaaaggtagagtcgagaaaactcttttgtcagatgtttcgttctacgtccaggacatataccgggataacatggcgttcttgcagatcaagattgactctgaaactatagagaaattgcaacttgaactaactttagaagacattgtagttgctattgccaaagctccaaagctcaaaatcggtacgaatgatatatcgattatcggcaaagataaaattaatatagctgtgagctcagacggaaaatctatgaaatccatatcaactgctatgaaggaacccgaaccaaatgaagtattttacagaatgcaacaactccgtcgtgctcttcctcatattgtcgttaaaggtttcagcgacatttctagggctgttatcaatattcgcgatgacgggaaaagagaattattagtcgaaggttatggattaagagacgtaatgaccacggacggtgtgataggctccaaaactaagactaaccatattcttgaagtctacgatgttttgggtattgaagcagcaagatcatgtattattaatgaaatcgattacacaatgagtaatcatggtatgagtgttgatcctcgtcacatccagttattgggtgatgttatgacatacaagggtgaagttctaggtattaccagatttggtttggctaagatgagagattcggttcttcaattagcatccttcgagaagacaactgatcatttattcgatgctgcgttctatatgaaaaatgatgctgtggaaggtgtttcagagtgtatcattttgggacaaaccatgtcaattggtacaggatcatttaaagttgttaaaaacacggtagtgggagaaaatgacctcacacctaaaccaacactattcgagaccctgtgtgatactgtagtaaaagctaactagtctttaaaatcatgtgcatgtatataaactttcttaattagcataacaattcttcaaaggattgatttatttgggtaatattgttacaaatcctagttacgatatttttatttcaagaatatcatcttcttcaaggccttcacttaaaacggtggctgctgggttgagttcttcattatcaaatattaataacacatttgcatcttctgaaaggctggaaatagtcttgtatctgttcgctatctccgtaaaagttgtattaggccaaactgaaattgatgttcgcttgtttgccttatcaattaaggttaaccgaatagaatttgatgattcaatatcagaatcaagaagatcaattacatcatctgttctctccgcgagctttggcgcactttcaagctctttctcaaatagcttgaatttctcatccctagccggttgttcgagtgggtcctgctcttctatgttgctttcatccaagaaggattgtaatctcgattcccgaattctcttatattccgtcttgtagttattggcatcagcagaatgaactataactaaatccactgtagtttcatactcgctcactgttttaggtatacgtaaactgtcacagttggaaaatggtagcacctccactcctgcccgaaataatactagttcagccggtgtatagaagatcctcaaccttcttggtatcttgtaagattggataaacgttcgtattgttattggtagaatactttcaaaagttttgtttcctgttactttaacatttactcttttgtcctgtgatccttctaaagtagatataaagttaatgttgtaaatccgcttggttaccttcccattattgtgagtatcggcgtgattcttcgcattactagtgacttcctttaaaaaatcaaacatttcatcctgtgtattgattgatggtgtttggtcttctttgaatctttccaattcactatgaatggagtcatctgattccgatatcacagagttttcatagcttgattcagcgtcatcgctgatatcgtttttgtctgatgatttagatgagcctgactgtctggtcaatttttttgccggttcttcggattccagtgccagggaaataccgttcttatgtggtctttttctatcattcttcaacgtttccaatgacggcagattagaggcatggatgctaatatcgacttctttctctatttcgttttcctcatctgtgatattctgattaaagaaaaagtcatcagagtcgctatcactcattcctttgagtgagtaagtaatataatgtcactagtggtccacaaatttgtcaagaggcgtgtttttcgtatactcgaacgagcgtagagcttctgtattatttcagtaactcattttttattcacagttaaaagcatgtaaaggttatgtgttagtgaacagaagttgatattggtcacgtgatactaaagtgggccaatgtgctacttacaagttggactacgatcgccaactatatacaaatagtatgtacgatgatgtttggggtttagatatttaagagaaaaaccagctagcataacgttggcatgtgcttagacttcgatagtatgctgaagttcagagtatctttcgaagaactttttgaacaacttcacttgcagttcgatatctttggccgaaccagtttctctgatagaatgcattgacaagatcgggtttccgatatccaatgttctgatacctgttttggatgctaggattggtccaattgttgagccacatggaacattatttgcaccaacaaataattgtagggggatttcagcttcatcagcaatttttttgagtaatactaaacctggagaatttgtcatgtacctttgattagcattgatcttaacgacggggccagcaccaaattgtggtttgtgctgagtttcatgttttgaagagtagtttggatgaactgcatgggcaacatcactcgataggaaaaacgatttggctgcagattgcaacaacgaggaagctgatgtctgttgaacatcatccgaacctgctaatggagttatcctttcaagtacattaggcaaaaaattagaatctgcgccttgggcggatgaagatccgatttcctcgtgatcaaacatcgctaccatacgaattccttcgtcttcagataaacccgtatctgctgcctcagtgattccgtgcattgaagtgaaacacgaggtaagattatccaatcttcctgaaaatacaaactcatcatgaataccacctagggtggaaggtttatgatcgtataagatcaattcgaaatcttcaatatcagtgacattttctagttccaagtctttacgaatcaattccaaaagatcttcatgatgcctctcgatgattgatttcaaagaagagaactggtcctccgatagaggttgtgaatccccacagcatccttcacttttctttgtttcttctttcttatccttaatagataaacctgcaatgggcaacaactgggtctctttgttgaattcgaatttggtgttaacatctctatccaaatgaatagctaaggttggaatctttaacaaaggtttcttcaaatcaactagcctcgaaacgatgttcttgcttttactatcttgaaccataactcttcctgccacagaaagatcagagtcgaaccaggagtgccaaatcccacctccgtaacattctacaccaatctgagagaacccctcattagttctcttggaaattggcttaattcttaggacgggggaatcggtatgagctccaacaatagctacgggattacctggtttccattttccaccaacgacaaatgcaacgatggaagagttgtttctggtaacgaaatatttacccagtttcttgaaatgagactcccaaggatccgtttccttcaattccacgaatccattcgactgaagatgcgacttgatattgtgaacggcatggtatggagttggggagctgttcaaaaagtttacgaattcctgcggataatttatgacactggaaccagacatggtggatttactcctcagatgtagtctcagcatgcaagatgggcggtgaaaataagctgtagcccgttatcgattccagaacacagtgggagactcagtaagttactgtggtgaaagtacatggtataggcttaaaaaatcaactgttcgaagaacttcttaatttttgttgcaaaacgaaatggctatgcagtaaaaatcatactgaaccaagcgccatattgaattaagtaatcagtaattcgatggaaaacgagcatagacgtcgaattctgacgttattagttcgagtatttggaatatattatttttatgtagatttgacttacaaattggaggcagtctttcccctaaatacttgatgggacaacatacaatcgaacctgctattgtatttggcggtgaaagagtgggaaatgaggaaaactatagttcgaatcagaaagtcgatacattagaccgttaactgtgtctcttcaacaagaccataacccctaaatagccatacaattagaactattgacagttcctcattccatacttctgtcgcaaagcgaccattatccaaaaggtccatggaaaaagtattccgacagctttatggtcacgtgcaatttttatcacgtgcctttagttctcccctaaatacacactttctctgctcgaggtggacgcagctctcgagcccacatttggaaaataccttaaaaagttcaagacattggggggcatggtatgagaaacatggatgttgaaagtatgaaatataaactatgaagtgttttggtatgtaaatgaaagagttgttgaaggtctttgaaactcttctcattgcattgaattggacaggacagatattcagtcaatataagaatccatccaacataaaaaactaggatcaattgccagtaatatttaatcaagccgtaaaacttgaatttctatcttattataatgtcgttatcaacagagttagtccacgcagatgacaagcacaacagagtcactgacatagtttctccaatcaatgtcgctaccacgttcaggtacgaagaagttgatttgattccatggaatgagcgagaagatttcagtgtcttggaaaagaagcctatatattccagattggctcatccaaactcccttagggtggaatctgtcctttcgaaggttttggaaggtgaagccgtggtgtatgccaacggtttggctgcatactttgctatgctaacgtattataacccaaagagactttttatcggtgaagggtatcatgggtgccgtagtattgctgatattcacactaggaattggaatttggagcaacacaagttggaaattgatgaaattttgcaacatgcgggtaaaggcgatgtggttcacatagagactccagttaacccgtacgggacctcattcgatatcaaagctttcgctgatgctacacatagtaaaggtgccatcttggtgattgattccacttttgcaccacctccgttgcaaaatccttgggatttcggagttgatgtaattctacattctgcgactaaatacttcggtggtcactctgatcttttagccggtgttctcgccgtcaaggataaagaagttgcttcaaaattgagaactgatagaatctatttgggtacaaatattgctaatttggaggccttcctgttattgagatctttgagaacatttgaaatgagaatccaaactcaatccgaaaatgctaccaagcttgtatcctacttgattgagcataaatctgatttcgaaggtgtgttagaaggtgtattccactcctcgttacagactgaacctttcgttaaggaacaattaaagggtggttacggaccagtgttcgcagtcactttaaattcaaaggaacaatgtaggaaattccctcaattattgacgtgcttccagcatgctacctccttaggtggtgttgaatctctcgttgaatggagagccttgacagatccctacatcatccccaccttgatcagagtttctgttggtgtggaaaatgttgatgatttgattaaggatttcgctaacgctttgaagactttgcaaggagcaaagaattgagtcctctcaggttatactagcgtttgtgtcaccttttagagtatattgtatatatttgaacaataaaaatgcatttgatactcgtctttacctgatctgttggtgcggtttcaatatccaatctttgtatattatttacgttaccctaattattgatttcgaacaatcatcggaaacatcataaacctgtaaaattggaaagaatatgtaaacaatgacagaataaacaaacaacactacaaggtattgattcacaagtcactgtcgcactattaagagaatcatatcatttttgctgaatttaattacaatttggcaatcaacgaagctgctcggcaatgcctacgagtaaacaaaaacctaagacgaccaaagcgtcaaaacccaccagaaagaagccaatagtgacagaaggtgtaagcgtggtagatctgatcagtgcgcaagaggacataaagtatactcatattattgatatacccgctgataaaaatgaaaatagcgatgatgtagaaattgaagacgtggaggataagaaatcggtcaagaagagaggtaggccaaaaggttcaaaaaatggtggtattaccaagaagactaagccaattaagatcaaaaccgcttcaccatttaagattgataaaaacaaaattgttagagtgagtaaacatttaacttcagtaaaagataaattggttaggatatacggcgagaacaaggataaattgttgggtttagcaatacagaaagaaatgtttgaaactgctgttttcgacttcaaggaatcccaactcgtggaatttcaactcccgtttcaagatattacctccacaattaaattcggagattttagtgtcgttagtatctcacgtaatgagctggacgaaattgtaccattaaacaatgaagaaatagaatttgacattgggaagaaccattttgcaacagttgcaaatgaagcagtcgagcttccggtgttcaactttggtacacggcatggttttgtatttaatgctggaggttttgtttcagattcggcttggaccaaaattccagattcagataagcaatatcttgccatttcagtctcaagcgatcaagatgctgcggatcctgatttgagattatcaggaaaaccagtaccacatccggcactactgaaaatatacgaacttaatatagttaaagggacaatatcattattctaccagcttgcgcatgattttggagtttcttgggatcttaaatggcaccctggattcagtagtaactcaacacatattggcgttttgactggtgttttccaagatggcactataaaatttttgccaattgaaaagagcttcaaaggccaaattcaccatttacacaatccagcgttaactataggagggattgattctggaatcaccagcttcgattttagaagctcaaacgacattgtgtgcggctttcaaaatggatattacggagagtattcggtcagcgacgataggttctatgaatacaagcagctttttgaatcgtatgtgatctccaccattgtattacgatccaattttgagaatacccttatttgcatgagtgcagtagatggtaattgttgcatattcgacccaaaggatattcggttaacgaaaaccttcgctacaagaactcgtggaagtaatacacttcctttaatatatcttcctcaactatacacagtaattcgaaccgattctctaagttcaattaaggcgttcacacctcgcgctatctttgtcgaccataacatttgtcaacacgataatactgtgatatcacttggtgcctcgtctcttcaccccatgttattatctggaagcgctgacgggagtgtggtgttgaataacctcgtacgaagaatgcttcaaggtttgaagaacaatacggacatttacaggtatatcaggttatggaaatgggatttcaatgaggaaaacggacaatacacgcttaatccacaatacaacgtttatcagttctccaatacagaaacttcaaatgttaagcttgattactcgggtatcaatattcaaagtgttaaatggattgaagatataaggtatggtaaatggtactcgtttgctaatgcagcaggatttgttgtaatagagaaattaggtagttaaataaaaagaacttctaacaaatgatttgcaactcgctgtcatgtttaatatttaggtaaagatggatttatctcatcaatatacttgaaaaacccacctttaacatctttgacatctttcaaattgaatttatctttcaatagcctggttgcgagctgcgaatcatttccgtatctgcaaagcactaatacttcagaatctgctgaaaggtggggtattttggattggagattattcagatctgctggtaaatctctaagttcattcacagtgatattatgtgaatttggtaggtgtgatatggaataatgaagacttggtctgacatcaagcaaaacgtaaggcttggtctttgatgaattccagtaatcccgttcaaatttatgcacatcgattctttcgtcctcagttaaaacactatagttacggctaccgcagaatgattgataatttattttgcctgattcgatagattctcttgttacagtcctgcctgttccacaagctggacaatctaccctcctacccctcattttgaacttacggagagtctgatcagggaaaccagaatactgaagtagaaacggcttgaagttctctctggtgtacacgccaagtaatagctttaatgcttcaaccaccattgccacaccaacaagcccaacgcagggtcctaagacaccaccttcttggcaggatgacaccgaagttggagcaggaggagttgggtagaagcatctatagcaagggcccacattatcaaaattgaagatagataattgtccctcagttctcaaagcagaagcagatacaacaggctttcccaaattaactgccacatcggatatcaaatagcgggccattggtgtgtcggtgcaatcaagaatgacatcgtagtccttgaatatatcaaaagcattttcattacttagtctgacaggataacttgtcactgatacatgtggatttaacttgttcaaaacttgtttagctgattcagatttgagcataccaactttgattgtatcatgaagaacttgcctatgtagatttgaagtgtctacggtatcattgtcaactatcccgatttttccaatcccagcacctgctaagtatggcaaagatgggcatcctaaccctccggctccaataacaagaacactagcatttttcaactttaactgacccattagcccctctgtctcatcaacaatcatctgtctcccgtatctcttaaactcatccaacgacatcggcaagtcactagcattattcaagcttctctccaagcagagatcattcttcaacttcgcattctctactctcaagttttctatctcttccaggagagattcattggatctttccgtttctgtcatatctccgtacggtctctagtacagttctgctggacttcgaaatttagacaagtgttgcaggcatcatattggcaggtataatcagtgctcgttaaaaggatgccttcgtgtgaacttgaatttgatttttcttttcttttgtaaatcatagtgtcagtttatgtaatggtaagagctgcattgactttttaactcaaacacacggaaaagcaacccactagccgccaagtttgatcatttaagcccaatagtatttacctttcaaaatatctcatgcgacaggtcattatgatgtttatgaataagtgtgtaattatctatttacgtctgtttctgcttaataaataaagtttttaagtagcgaagttgaaagaaacaggtaacaacgagcacaacagttaacagaattgaccaatatgttacactttcattagtcacctcagtcatttcacgaaacacagcttctttctttttgatgtcatcttgttcgttctttatactcaatagcctttcattcaattgatatattctgtctttaagagacaccattgcagagtttctcctactttgcaatgaaattgcactaccgatatctatcgcatggtatagcttgatacgtctggtactatcagggtagtatggttctaaacaaattttatgctctcctttttctactgcactgaatgaaaaaggtccttgtggcaccgctttctgagccaagacacgatggttgttatcaaatgtttcatcaattgttattgataacgttaccaaatcatccttctggaatgttccatcgtcttgttccacaactgtatcgaagtttgctgctagcaattctcctttgtccaagtgctcatagtaacattttatttctccgctcttaagatagatatgcatgcattgagctagtctgcaactcaggagcatcaacagcacattgaatatatcagtgcttctcatctaatactaccgattaaacttgatgactgttgtctctgttccttaccttgctgttcgtatttttctcttcgggtactcgatactgtaattcgtgtctttattattttcaaggcaagaaggtataatgtgcgagaaaccttaataagatcggatacgatgtaaaatatccggtaagtgagcccgatgatggattttctggctttaagtccattcaattatctgtgaaaacgggcgtttatttaggtataaatacataaatatacttaccgttgatacaataactaaatactgggattcaaaaactatctaacgtaacccactatcctgatttaatttaactcaatcccattcgatatggtcatactctcatattctcgtagtcaatccagcttggcggtgggaaaggcaccgttggtatcttaatcttctcgtcattgccgtatttctcataccacatcacttctttcttgctttcaaattgacctttgagtgagtctaacaggtttatctctttctgccaaaatgcagtgaaagaagagttctgagacaatagattaatggagctgattttttctcgacgaaaagtaatgtatttggacaggaaggacttaaattcttttaaggttttttcataattctctatctcatcatgttctccgaaaaactcttctagacattcttccttgtcgagcaacttagtggtttcggttccgcatttatctttaagtatagaacaataggagtcgttcgtttcgcttaattggaaactgatttttttcggatcctgtaaatgttgagagaaaagaatgaggagttcgccgaactcaacgatacaatcattgattagaacttctgatgggagtatcaatatctggaacgaaggtctcactcgcatgcatttgtaaaaatgagagacattgattccattatagtggtaagtactgaggaagtcttcatcaaatctgtaacaccaaacttggacattattggatttgggtaagaatccataaatttgttcaaaatggactagctcttccactggagcatagcttataaatacttgagcttcttctacggtagagtcaatatcatccagttctaaatagagcacaatatcattagttctaagatcaatatcaaagtgagcatttctatggtcattgtcatgattaacaaagtccaataacgggaccaaagttgggctgacaaaaaaatcatcagtatcctctccggaggattcgggtatctccaatattctggagataacactacaataaacagtggatattaatttttcatagttcatacctagaaacctcgctgatatgaaacggtttataatttcaatgaacagttgttgaggaaagttcaagtactctttgtaatattggttccacttatcggcatcttcttgaaaagtattgcagggaagtgggacaaaagtctttaaaagaacttcgttcaagtaaaaagatgcgaatccagtaagtttgtaagttttattatctgaaagaatagcctttaggaccaaatatatcactatcaggttcgtttcattgataaatgcgtggtgattttcatcgcttaagaaagctgtcaagtggccctttatggaagcagtaaccgcattttctgatgtacttttagccaatatgtctcgtatcgatgtcattgatatagtagcagatctcggaatcctgagaagttcaaacttactgtctttctctcctttaagtgttcttaatttggtgaaattgacaaacacaccgtaaccgccggtgtctccatcaaccactgactctctgatagtagtacattcactcttggttatgggagtattctctagtagccattcagttgctgcttccatcttatattgctgtttgtttatgcttgtttatggatattattgcatcataataatggtactcaagcaagcaggatactttttatataattccattgatatgacatagaagaaacgaagcaaaaggttttacagtttaatttaggtcaggtttgagagttgatttaagtagggtgtatatattgagtagtgctttgcagttgcacttcgagtcgctagtgatatgttcccagaggtatcttaaatatgatcacgtgcttctagatgaaccatgactcccctactgcagtcttctaaaagataaaacttaggattaccgtaatagcaattcgctgtacacgataacaactgacaagggactcgctgattgatattttaattatccctttcatttttacattcttgacagcatcgcatgtcatctttaccttttcgaaaagaaactattctttaaatttgatgcaaacctgcatttggcgagctcatcactactttagaatagattcgaggaagtttcaaagagataaacaatagttattagttgggctttattaaaccagcaacaacactctattttagtctgcaatggtccaggttgttaaattaagtgcattatccaagaaacgtgcagtcgatgaggaatctgatcttgacatatcaagtacagactcaaatatttcagaccaagaaaacggtcaagaggaacaagaaatcatcaacatcgattttgatttcttcaatggtaatcccgacgttgatttccatgctttgaagaatctgatgcgtcagttgtttggaccacaggaatcgaacagaattcaactaagtgaattggcaaatttaatcttggactcaccaactactaccatcaaaaccgatggtaaggagtctgacccatactgtttcctatcatttatcgattacaaggccaacaaagatagtgattatgccaaatatcttcgtaaagttgaccccaagctagctactttcctacaaactatagatcaatcggagaagacttgttcgttagtcttgagtgaaagattgattaatatgccaccagaagttgtgccgccattgtacactatcacattagaagatgtgaagcttgcgcttggggatgataaaaactatgatttctacctaatcgtttcaaggaagtacgaagtgaattttgatatggacgaagacgatctaacatcgaaccaagctgtccgcaagaaggtaagacaaacaaacgaagtagactatttccatgaagaagatcgtttccttgaaaagctagccaaagtccatgtggattccgaggcgagaaagggtcttattacatcgtacatggttttggaccatgctggactaattaaatccatcgaagatctagatgcggccatcaagacctggtgagtgatgtaaatgttcagtagttacattgaggaaggtgatgatggtatgtggattaatcccgttctgggaacccaacaattaacgcacgtgacctgatctttagttaccctccttacatgatttcggcctcccaaaagaaaaaaaaatctttcaaggaacaaaaaaattgctgaacaacatgaaatacgtacttatatagtagaaatcgagaaaacaagccgtaatacggtaacagaacaggaccgtgagaacactattcgactcagtttcaaaagtacctgacacagaaaagccttgtttggttggacgatcctgttgtttgtacagaagcgtgctgtttccgagacaagccctcgctaaaagaaaaatcagaggacccagtttcctttttttttttttggatattttcctatcacttgccattcagaccgaaagttatattttttcaacgtgacagatattcacagaacatctaatagaaagtaaggatttcaaggcgatgagcagtgcaagcaaagggaatgctactggaagtaagagcccagagcagctcttagaggagagacggcacttgctagtacaattgtactgtatctcacaaattaccgagttaaaaaacgtggagaatcatgagagaatagggaaggagatagaaaagtttttagatcaacataccttgatcaaggacaagcctatagatattaatgcattgcctaagtttaggccgagagacgtgtcgtcagataggaagctgaataacaggagtaagagttcttcaccgtcagaagtgaaacgagaattgaagaaacagcggtcgaaagacgtgtcgccaagtggaagcgaggaacatgatgtggatacgcagacactcccgcagtctcaaacaagggtagttccacgagttcagtcacagcagtcaattcagcaaagttcaaggcaatctatggtgcaagcgcagtcatctcgacagctgcagcagcaacaactgcaaaagcagcgatcggtgtctcccacacagaagctgccgataacacataataatgttcctcctgtggtagttcaggcacatatggaaccgaaatctgtccaatatccggagacccaatcaaagccaagtacttctggaaagcgtttgttagatgaggaacaacaagatatttccgaaaatcaaataagtaaaaggcaacggcttgatagtggaaacctatctaattctaccgctgcacgtaacgctgcaacaatggaaattccgcctcatccttattctcagatgatagacatctcacaattgcatgctgacccaacaccaattggggtgaaagaacctcaaccctatattatagaatctattatcaacaatgtatcaaaggaagagcgtaagacgtttttcgaagatgacataaatgtgaaagaggcggtatacatgattacgaaagagaacgcgccaaccaagttggcaaagggtatgcccattcaagaaatcaaatacttatcccagactttgcccttgctgagattgataccacaatctcaaaaagcattgacgactgatctgattaatactgcattgaatgaaagacgaatcactgtagtagcatcaaggatagaggaattgagaaggctgaatctctggtcacttagacaaccaagaaaatttatcgatcccgttaccgcttcacaacctgtaactcatcataatgtgttgattgaagaagcaaaatggatgcgtgaagacttccgtgaatcgttgaattataagatagccatgtgcactcaaatggcacaggcagttatggaattttggacttatggtaaagtatgctgtatcaattgtaaaagtattccaccgccatcaaaggacatagaagatattgcttcctcccaagatatgggaacaaaaatcagtacagttgagccagaacaaaaagataaagaatcaaacacaagtcctgatcaatccaacgatgatgggtcttctaaaattgctgaagatgtggagatgtcagaggatggtgtaaaatcaagtaccggtttaactgatgggagtgaagcggtggaagagaagtctgaaaatggtatcaaagagggggacaaggaaactgataaaaactcatctgaagagcctaccatagacatacaaaagttactaaagagagttaaccccaaagatgaaatcgtcgctccatctcttccggttacctccatggaagtttatttagctaagaaatcatcctctcccttcaggaattacattgatataaaggaattatcaacactgggagcagccatttcaaactcactccctttgtatggtcttttggacgaaaagaatctcgattctagcagaccattgccctttgaaccggtttcaaaggcaatttctcctcttgacgaggaccatttcatgaaattagtagaaaagcaatttgttgacgaagaaccatctctagttcctttatcaaaacgacgtggtatgttttatggaaatagacgtagccattatcttcgccctcctaatgcgccatcattacgctatttgaaatttcgtacacccaccatctggttacctgaagatgatcaggagcttgtcaaaaatataaaccagtatgcctataactgggacctcattagttctcagatgtccaatcatcacaaaagagaatatgtttcaaacatcgaacgtagaaccccttggcaatgctttgagcggttcgttcaactaaacgaaaagttcaacattgcagatatgaagggtccaaaggctcataatgcacaaatatggttgtacgaagctcataaattacagcagcagcaaaaaaggagaatatctccccttggtgtgggatcggaatccatacaacgaggacataggcgtttacgctgggcaagtatgtttgaggcaatgagaaagtgcattaaaaaaagagaaaacgcacccagaccaaatccttcgcagccgcgtaaaccttttgatgttaagaatatgagtgttccaacccctcaagaaatgtcagacttaaaagctcagcgtgatgaggccttgagaagggatatgcaaataaaacgtgctgccaaacaaaggatgcagatggctcaattgcagcaaggaaagcttcctctcactacagcatcaagtccgaatttgcctatggcaaataatcctaactcaaaggattcaagaattaggtctaagcagtccactccccagagtgcaccaccactaggtgaaaaagaaaaggttacaactcaaactcccacacagagaaatacgaaaccggctaataaacgtgaaatcattgaaggatatgccaaaaaaatactttttcagaaacccaatttcactccagaacttgctctaatggctgctgaaaatatttacaggagcttgccattgtctgatcaacaaaggaaaactgtaatttatgacaatgttgcacaaccgaaagtgcgtccaccagagatgaaacattcttctccgacgcctcaagagattttgcaacgtgctcagaaaaagtgaatacaattaataatatataatcagttcataatcacaacattgattcaagcaaagaattacgaataatgagtccttttgttataatcattatttcaatatatatatgtatgtaaattcaaacatttgggaaagtgtaaacagcagattcctcctttggtacgccgttggctttgtaggatactttccatttcactctgagtggctttggggcattcttcactgcgttatcaatccaacttttttgatggattccatcctttgcataggatgacaaaacagtatttgattgtggtaaaagtctcaattgttgggctttaggaaccgctagcattaatgtaaggtctgtaagttgcgaaattgacacatttgaaaagaaagaagtcaccttgatggtgctttctgattctctagaaattgcaaattcaaacttcaaaacatctgactggtttacaaggaaacggtcagacactatggaaggttgagtagaatgttgaacggctggtgctgaaaactcactcaataagtcattgctatgagtatcttgttgagcttggacaggtgatggtgatgatagatcactcaacagatcgaaatttgagttggttgtggtagttgtggtaacaggtacggcaggagatgcatgagctgctgtgtccaaggctatgctgcccccaaatccaaagttgttgttgttgttgttgttgtcagagaaattcaagtcattcagaccgctcaacaggtcatcttctaaattgtttctggcagcagcagcagtagaatttgaagaagaacttttattaacttcttcgtcatcaaaatcaatcaaatttatttcattggctaacgcaccaccattattaacagatgaggaaatgttatcgacattaatttgatttgcttcaccagcatgtcctgctttcaataaatcatacttttgaaccaattggttgaccgtatcattgaacttgagtaaatcctggacaaattcatcgtcatcgtgttcttcctcgataattttttggaatcttggctgtgatgaccttaaagcattatatagttcgacaattgtttcattttctatatctggtgagtcgttggtccctaacatttcgttcaacaagtctgccttacgtcttagtttggttaattcttcatttaagatctgcttagactgaatcatgttgtcttccttgaatccggccatgaccttcatcaatttgttggcttccctcaaatcttcaggtttaccacgtcttatcaattcctccaatttggcagcttgagcaatttcttgttctttttgaatttcacttggagttttcaaatgttcgcttggtttcaaaacagcgagatcctcactgttgatttttgggaaagtgtagcctttgtatttcaatagcctatgcatgtccctaatatatcccatatcttctttataagcagagtgtttgcaaatagtttggtaccattcctcaatagcagtcaagattagtcgttgcactttactaaaacggacgggtggtctctctgggaaacgcttcaccaattcgttcaagaattccttcctagaaatctgtaaatggaatggatacccacaattcttgaccagtacatctaataaactcaacgcgaagatagctgtatgagtatctcttgagttaatcagtctcacaatggaaattgcggcttctctcggagcagcaccctgcttatcgttgatatagtcagcaacatccaaattcaaggccaaatctggctctggaagagaaatacgacaagccctctgaatctttctagttaatggatcggattgcggttgcatccgtctcactggtccttcatccagatgaatagacatcatgtcgtgttttcacttagaaacaaaaaggtgaaagatctattcacggataagagttcaaatcgattggagtcctaccgtttgagcactagtagttggcactttctaattgacctaagcagaatgcgatgtagagcgttgaatccagtaaggtgaaaatatgttcagattatggatggttgagaaattctttaacatatctgaagatgaataaagcctttactttattttttttcctgtaaccaacatttggaaagaccccttttaaagaaagatatcaacaaagagtggtttatgaaacactgagaagatattcagcagaggaagactactcaaatgtcagatttggtattcattaatgtgttaatgtatctgtcctgaagtctgccaattccggatagctggtaataaacatacttgaagtaaaagagacaatgctatgatgagtgaaaacattacagcagtagaacctcaggaaaacaatgatgtcgaagctgatagtgaccccttcaatatcgacaagctaattgtcgattatgattatttattgtacaagattcaagatgaattggagtcgatccaattaaagacgttagagatatgtcaaaaacagaatgaaatagttgaacatggtatcatagaggaagtcattgatggaaatattgggatggcgaaggatcttttacagaaatgtgatgatttggagaagcattatgatcaattggatgcggttgaaggcattgttgtatcattcaaaagccgattaaaaggggtaataacacaatataaaaaatatatagatacgaagaagtgaatatatgttacgaaggcttttgcattgtagatcaattaacttcattatgtttggtggctgaataatgcattaagcttccgattgagaaatccgaaagatgattaccaagagatgttgtcttgattcagaacaattttccttttcaaataatctaacctctgtctatcccatctgcgagcttcaattgtagtcttcattctgatgcatgaaaggaccagaagtgccacggtcttgaattttatcttttgatgagagaatcgcatattgtggaatggtatatctgcatatgggttgtaaactggtacttcgttctgtaacttcagaatgtctaatttgacgtgttgagaacttgcccttaagacacggtttagatattggttcattgtcttcaagtcattattttgtttaacttcattggcatactttaagcggtaataatcaatctcatcctttagggttcccttctcagtagtttttgagaagacctctgctgtggaatttggatttgccttctgtttcaataaactcttctgcaactccaaattttcgtcttggagtgacttcaactcccccaaaaatttgtccttcatggattgatatttggaataccatttattgttcagaatatctttcgcatcttctgagttttctgcttgttttgacgcgtctttcagtttcacgaattctttagtgatgaattccaatcttgattgattctttttcaattcttctttgtaatcatctttgtgactcctgacttttgaaagttcattcaataaagagttcttttcggttaacaaactgttaaatcttgattgtagctgtaagatttctttgtctttttcattcagaatattggacagttggccggattgatctttgccctcttgtaaaagctcctcatttgaacgtcgtatcgtttcatactttcttctccacatggctagttctttttctttggtatccttaattgagtttagttccatctgcaacaatgatatcctgttctgcaatttacttttttcttcgagaacatctgtgggaagatcagggtttacttgcttacgcaacttttgaatctcttccttatgattttccttgagcttggaaacgttagatgttacatcttgcaattcatgttccaagtctttcactgttgaacgaagcgcccgaatttcgttgttctttctttgaatgtcaacctcgaccgatttttttgaaggagattgtcttatcaaattatctaatcttctcgacaaagagttgttttcagttttcaatatgtcattactctttctcatttcaagtagttcttgtctcattgcttccacttcacttgaagtatatggtaattgttttcttagcaattcactgactttttctttatgtttatcttgtgaagcatgtaactcttcttggcaagaattgagttgatcttcgagagattttacagtttgtttgagatctttttcagaaaacttaagtgatttattagtttcgagcaaccttagtctttcagaagataattcattgagtctcttaactgcttcagagtcactcgatgatagattttcagtcaattgttttatctgttgatctttatgagtgattatcttttggtgggtctcccttattgaggacagttcctcttgtaataaagatacttctctctccaatgattgtctctggtgttcatttctctgtagttgggcttcaagatttctgattgcttcatttttagaatcaagcgttgattgaagatctaataaactaccgctttgatgatcaaactcttgaagctgagatgtaagccatttaattttttcctttaaatcagaacattctctttccttagaagtcagtgaagtactggtctcgttgatcttactttgaagaaggtcaacctgcattccatgttggcattccttttcagtctgttcagttctcatattgaaaattttattttctaaggacttgattgtatctttaagctgttgcaactgtgcatccgtatcaattaggttctctttcgtcgagcgtaattcttccttcagcttatcattcgattctttaagctttgctatatcttcatgttcatcattctgatcctctattctatcacattgtttttgcaaagccgtatagtcgagattcaactgtcgataccttactttcaagtcatcaagttcatctaaaatctctaaattcttcacaatctcaccatcatcagaaatgttgttcaaaaacttcaacaaactggtgcatttaatccgtaaattataattttccatctgcaatttcttcaaactgctctccgtttctttcaacggattagaagtcaggttttcagtagtttcttgatccttgataagtaaatcatccaccaaattctttcttgagttcggcctacgttcttgaatgatgccctctggtacagtctcgtcaaaagaggtatcattgaaaagccttgtagaactaaatgtctcatctactacactaggattacgtacccttttcctctcagcaggaagatcactgccagattcaagtgacctttttaatccgttttccttcagtagatcaataccttccttacgcttttcctccgcatatccgataggagtaaactcgtactttttcagcttacctgcatgtggtgtttccatcacagaagacatatcatatgtacgctagtccagtggttgaaatgtacaccttgaacatgtgttactctgaccctgttctgtttacttttcgtttgtttatgatttgggaatcttttgatatttgtgtaaaagctaaagaacgcgtcatttacccggccaatataaactgtccgatgacaggcgctaatgcaacataccattatgaacagaacgcactcgaactctattataggtgctatgtattaagtaacgtccacgctttctccataagttgatatacctgcccgtatcgaacatcttacggtagttttgtcttacgttgaaacttgaaagaactggaacaatgaagttggctttgatgtttactgaactttgggaactcagattgaaatttaacctccaaattgtaaaaccgttgaataccactaagatgattctaattaactaccttggatctatgcttggacttttcaacattaataatgcatatctatcaaattataatgtatgtagtcgcgttatttccttatataagtaatccacgtcgccccaatcgtcctttcccttctcttgaacctcagcgatgacattgagatcattctcttcgagtagtttccatagaagttcgcgttctgattcatatttgggtctaattggtatttgtaagtatacttttccgttttccgagagaaattttacgatcatatccacaagccatataggatgttgtggggaatatatcggatctgctattactatggtatcgaaaggttcatttccatatttctcggtgaatgacaatggatcagtccagtcaagcacatctgcggtgacatcgtttaaattgttcagtctgacattgtattgcaagttcggcaaaatctctggaagatcggttaaaaatattacagaatcgccgttgattgagtgtgtcaatgcatatgaaattcccactaatccggtgccggatcccaattctaatactctttttccagctggtataccgattatcttttgtgacaacataagggaagatccccaagtcttcaatccaaggttgtccgatgtcaaagctggctcgtacaatttaattgaagtatccaagccttccagcttaaacgttcgggtcatggagggctgtgcagttctaccgcaacgctcagagatcctcgaactagcttgttgtaaaatctgattagcgagctcattggagctagtttcatatttcgataagatagttgtgaaatagttcaagagttctgattcggatgatcgattatggtaaagtgcaggtatttttgtgcaaagatctgagtacgatcgtagtaaattattgatccattgttcgtaatactttagtgtgagctgtagcatagattctgtcacccctttctcattgcacattttttcccatgtctcatcattctttccttcagcagacttgaaattaacttgtgttgcaggctgtaatagcttcagtacggttaatatcacatcaggggcagcatattgaacacatggaaggtccaatggctgtatcggaacctctccttctgagggccaggcatcaacgtcgaagtcatcgctcaaaggctgaacattattagtatcttgatctgctcgttcaagaaaatcaatattgttggatttcgtcacagcgttactacttataaaatccaagggatcaaacgagtcagccatcacggcagtttgtacccgatgttttctgctttatcagggtccgattcatctcttgagccatccatgtgacaaatcattcacttgaatcgaatatgataattttcaccaaacattgaaaatcatacacatgagaaatagtccaataaatacgatatgacaatgtatataacatatatatacattggttctataaaaccgacacagatcgtataaactgtgttaatgcacctaaagctgctccagaatgaatactcttttcagcagcatctacacctagtttccagtcttttgtaccacgactcaaacagtacaacaaagctgtatttagcaaaatatagtcgtagatcgggttttcacctttcttgtaattgcctgacagtatttcttcagatagtatccttgcattctcgcgagggcccaacgatgggcattctgcaagagtatgctcttgtaaaccgaaatctgacgggtttatagagaatgattcgacggtaccattcaaggtcacatgccaaacaatagtgttccctacaggtgatacttcatcgagaccaacttcaccccaaacgacgaatgtttcactgtcaggatagataagtcttgctgcttctgcatactcaggtgccaattccttggagaagacacctagaactcttttttgaacatgggatacaggatgcaataacggtcccaagacattaaatattgttgggatacccaatgctttcctgagcagagcgacatgtttcataccgtcatggaaataaggagccaatagaaatgtgaacgaattttcatcccaaattttaggtaaagtcgacgcagtcaccttagatgaatcacaacctaaaactccgatcaaatcaccagcacctgaattggaagtcgatgctttcccaccatgtttacaaaccttcaagcctgggatgcccgaagcgacaatggctgcagaagtagacacgttaaaagtgttttggccgtcaccacctgtaccgacgatatctaagacaatatcatcagtatgagtcaaggtcgttgaatcgacaacagttgaaaacttcaacacagccgaggcagcagctgcaatatattcagctttgtgatccaatccagttgctctcaacactgaaaggaaagaggcaatcggtaccacagcttccacagtaaattccttcgatagcgtatcaattatgtaaacgataacttcgtgcaattctgcaggagtcaaactaggcgggctcttcaaaagcttcttcgtaaaggaaataatactcatagttacaaaatgtagaagctggtaacacagcgataccttaaaggtaggaaggcactacttagcagtgagagtagatttgccgttatttaacgcaaagtgattatctttctatgtaccagtttgatatatgttaatgactatatagatccacggttcgagaaataacagaatatacattggaaagcacgtgactcgcttctcattaccctacccttctttgctcgagagatctctgaaatgttcctgggaacctaggattcctcgacacgaaacaattcgaaactttgttcaaatatagaatactggctaaaacaagcctatattaaaattgaaattggaattacagtttgtttacaggagttatcgtagctacctgcagtaacaatctgaccttctgttcattagcaaatataacattgtgtgcttcagcaaaagatagtataattggtaccaattaattgcaacggaactttgaaacaatgaccacggaagaatttgtaggaatctcgaatttaccaaatcagatctacaagctggtatccaaacaaggtggagtattcaccttgttaacatgcggtgaaagtggtttgggtaaaactaccttcataaatacgttgttccaggcaacattgaagccatctgactcccatacaggccgttcgatgcaagggccaattaggaagaccgtggagattgatatattacgtgcagaactagaggagaagaattttaccttgaaggtgaatgtaattgatactcccgggtttggtgacaacatcaataacgataaatcgtggcaacagatcattgattttatagacgatcaacacgattcctatatgcgtcaagaacaacaaccatacagagatgtgaaatttgatctaagagtacacgctgtactgtactttatcagacctacaggacatggtttgaaaccattggatattgaaactatgaagaggatcagcactcgtgctaacttaattcccgtaatcgccaaggctgatactttgacaagtcaggaattacaagatttcaagcttagaattagacaggtcattgaggcacaagagattcgtatctttacaccacctttgaatgagacacaggatgatgcagccgctatggaacatgctagacaactaattgaatccatgccatttgcaattgttggttcagaagaacaattcgataacggtagtggtaccaaagttgttgcaagaaaatatccatgggggttagtggaagtagagaatgatcaacactgtgatttccgcaaattgagatcgttgttgttgagaacaaatctgttagatcttgtcttatccactcaagagctacattacgaaacctataggagattacgtttggaatctcatttgaatggatcgtctaacgataacgaactaggagaaaaatcggcgaacaacttcgttgctgcaccagcaagaaaattatcacataatccaaagttcaaagaagaagaaaacgcactaaaaaaatacttcactgatcaagttaaggccgaagaacaaagattcagacagtgggaacaaaacattgtgaatgaaagaattaaactgaacggtgatttggaaaagattcaagccgaagtaaagaaattagaagatcaagtggccacattgaaattaagaaaacgctagggtgtaatggttcgaaattgtttttttcattcccatttatattccttttaacaacccaatttttatgttattttccattctcacattattctcattgaataatgccatttctgaaccttgtagaacgatgtccacacagttgttattttaaactactttctattgatctttcctatatatcaatataagctgtaaagatgatatgttatcattatttattctttttttctctactcggaagggagagtatagaagatattggactagcggtggaaaggtgagccttatagactaatgaaagaaaatcttcctcctgctgagaaactaggaacaaacataaatttcaattaaaggagtagtcgcgatgatatttatatataagatatagacataatatcaaagctttgatatgggaatctcaccaaatttatcaatgtgtatctattctaattcagtgatgtacttttcagcatccaaagcagccatacaaccggaaccagcagatgtgattgcttgtctgtatctggcgtcttgaacatcaccagcagcaaagacacctgggacattggtcaaagtggaacctggcacggtcttaacatagccggcttcgtcaagatcaacttgaccagcaacaatgttagtggcaggggtgtgaccaatggcgtagaacaacccgttgactggtagatcatattcttcgttggttttaacgttttttacctttaaagcgttcaagtatttaccatcacctttagcttccaaagtgacatggttgtatagaatttctatcttttcattctgttcagcacgtctttgcatgatttgagaagcacgtagatggtcctttctgaccaacatgtaaaccttggaaccatatttggtcaagaattgagcttcttcacaagcagagtcaccaccaccgataacagccaatggcttgtttctgaagattggaacagcaccatcacaaacagcacaagctgaaataccttgttgccagtaagtttcttcaccaggcaagtgcaaacgcttggctgaagcaccagtagacaagataatggcatctgtggtctcaggttcttgatcctcgttaaactcagtccagaacttgaaaggtctagaagaaagatcaacctttgaaacagtttcagtgataacatcggtaccgaacttgatagattgagccttcattctatccatcaattcactaccagtcaaaccatctgggaagccggggaaattttcaatttcagtggtggtagtcaattgaccaccagcagcaataccattggccatgaaaccttcgtacaaagtaggtttgatctctgctctagccaagtaaatggcagcagtgtgggcagctgggccggacccaataattgtaaccttgtgatgaaccattctgtagaatatattactctcgttgatatttctaaaaaaccctcttaatgatgataatcgtcctaatgtactatttctcactaaaagcatacaataggaaatctggtatctataatatttcttaatgcgacaacaagtagcaaggcgacagagaataacagttcaatacagattgctatttgtaaattcacatatatatatactaaaagaatcattattgaaaaagaatctgggtcttttctcaatttctaatgttcgttgaagaaaaacgaaaagcctttataaagattattatgaagattagtaaaagacctgattcatctagattcgtaactgttaaaagtgaagaagaagagacaatcggggagaaaagtaggtttcggtacgcttataccgtgtactaatgtgatatctagctggtgcttcacatgaaggagtgtatttatttatcaattggtttgaactataaattactccagtactattgtactgatactgtctttatcgctcataaaatagcttgacttatatagggtacagaaacattatatgtaaataagagtctttgcacgggttttagtacagagcaggtaatatataggtgagtggcatcaattatgtcgtgaattccatctgcattagtgtaattagatgaaagttgggaattcgttgtctagccattcccaagggtcattgaatctgatattttgattcaagccggaaatttgcttcaattcatcatcggtcaaagtcaatgcatcgttgatcctcaagttatccagcaatctttccttctttgatgattttggaatgatggcaatgccattttgtgtggcccatctcaacagaacttgttgtggagtgactttgtgcttggaagcgatagacttaatcgtgtcatgctcaaacaaagtaggggtgttaagagctttcttgttttccaattccaggaacgacactggaccgaacgaggagtaggcaaccacttgaatgccggcattcttgacgtatttaatcaatctttcctgtgtcaaatatggatgatgctcgatttgtagggcaactggcttgatacgagcaccacgtagcaaatcttggatcaacgcacctgaaaagttggaaatacccaaggacttgatcttaccttggtcgactagtttttctaaagccctccaagtgtccaatagtggtacttgttcttcttcaatgtgacctttagcttcgtcttccttaccggtgtagaaacctggaggatacttctcatcgaatggcacaggcttgaaggccaatgggaaatggatgtagaatatgtcaacatagtccaattgcaaatcggaaagagttctttccaaagcacgaggtacgttgtccggatggtggaaactgttccatagcttggagacaacaactaaatcctctctcttaacaagcccttctttgatggctctgttgacaccctgtccaacttctttctcgttggcgtaatcttgggcaccatcgaataaacgatatccgatcttaatggcttcgtaaatttggtcggcacaaacgtcgttgggcatcttccagcaacctaagccgactagcggcatcttttcgccattgtttaaagtaactgtttctgctaagtacgtcatctctacgatattatctttagcgtgctatattatcactaatacaatcgttgccttgttggtggtaacacaagttgccaaatggtacaaaaatcaattgctacttgtagaggtttgcactcccttatatactaaaatctaactaacaagttttccgtagattctctattttgcttcaccattattgcggaagagggcctaaactcattacatattgtacacaatattgctattccagctgaaagacgagtgcgtgcagtgacttcccaatcaagccacactgtattaatttgccttcgctctttcccacataatggaaccttgattccggatgctagtgctgatattgctatgttgcgagctacgatttgctaagaaacgagtaaaagaaaaaaaaggcaacacagaagaagacacagtagcaacaataattgttatgtgagtaacggttgttccctcatttatccgatgctcttgaacgtaagtcccggtgtcgatattttacgatacttttcgccctcttattacacggtgttattccgttgttgaaaaggcagtggttcagtccaggggcatggagtagtcacgctgtgccacggactggtgtgctccatgacaaatgacatgatcggtcccatattcaaagcagggcattgagaaaccggtcagtagtgccggtgttttcgaagtttcaagctcgagaaatgattacatataattattctgtgaatatatacgtatatgtgcacattggtgtggggaagaacacagaaattgttaataggaattggttgataggggggaaaccgttccgtcattcatcaatggagtgaactcgtcagattcaagtcttctaatgttgtagtcttccgcgtacaaaacgtagtgttggtagaagtagatcaaatcgaacactacagtgcctgcgctccccacgataaatggtaatgcattgagtacgaaacctagcttgtcctcatctgtgagataagagcaactggtgaaaatggatagtgtgtatgtgacatttgcaattaacgtacttataaagaggaggggtgaaagcccatcagtactcttccttttgtaattcttgatcaattgtggaattctggcacagaaataggacattgctccgacccaggatgccaattgaccaataaagcttgtatggggtggttcaataggcacaacgggcgacggacggtgcttactaaacggaaaaactgtttcggatccagtaatggcttgagcaatggacacgacaggcatcgggaacccttgaacagttccaggctgactgacgaagaatgataagatccaccatttgaacccgcgttgcaattgaatactggggtttgaaccacggcttcgtaccaaacgtgttcgttcttctaaagtagcagactcatggcctggagtcgctagctgattccggtgtaaaataccgtagtaatagtattgaccacatatcaacatgtcattagacaaataataaactgccaaaagaatctggaatgggagttgatgagtaagtacagctccaattaaactggttatatccccgaaaagccagcataatagaaatcctggtgataacccttcaacactcttgtcacgataagtttctatcagttgtgggatttgagcgacgaacgaagttaaaaacgaaatccctcctgaagcaacactaatttgaggccatagcgatttatcgcaccaggtcggatcactcatgttatcagttttcctgtattgtcacttaaaaaaggctgttcttaatgttacagccctttatcctcgaatattctaagtcttgtcttcttgttcctcttccttgttacatatcaaaccatatatgtaaattccaaattttttttgaagatccttcctttatctttctattcttcataacaattaaaactttcgagtcatatgcctttcttggtagtgatgagaataatagtggtaatatagagggagcgccctagttatacctcccatgatagtagaacatgatccttatataatgtttgtaagataggacgtcattttggaggacaattattttgctgtgaaattatttatttacgatgaatttcacgctcttttcatggactcataaagggattctaaattttcatgcatggaacgacaccaattatatgtaagaaaaaagaagaactcaacaatgatataatacaacgtgtgcgtaattgtgttcgatgtttggtgtttgtgtatatatatagcttcttatacatagcatggttgtgaaagcttttgctgtagtgtcacgttcgcacggctttccagtgtcatactagaatttggcataatagtgattccatttcttaataaataccaaatattggtcactcaccggttcgcgattgtcaactggttttactaattggaatgacggtggtagttcgtctagatgaagtagattgttccagccaaaatggtaccttagcaaaacgtttaaagagagagagcacaagactttataattcacaacgatatacttttctttaaaggtgtcccaatcagtattccgtagctgatgttgccactcttctgtccagcgtgatgctctggcgttctctgctacaattatatccatgatccatataaatagatcgtgatctactcgagccagacagttccagaatgtcatatagttcaagtaccttgagtcgaattcttccgcaaaggctgaatcctttctcatgtatctcccgactacaccatccctgttcattatacgattatcgtatttatcccttgtaattgagttgaaacaagtcagttgtagcaggtttgctagcttccagattagctctaggtcgtatccctctaaaaggaaatggagcatcaaatagttatctccagtctgtaatccgaatctagagattgacttccactgcaataacttgatcagttttgatcttatctgtgattcaactggaaaatgcatatcgtccactaatttattaatctcagccatttgggtacttgggaatggagtcattttagaccttatgatgttgtctaaactactcgtatcgtccatatacttggtagaaataatgttaaaatccgtgttcaacacagtgttataaataaaagatcttctggctgaggaaaagcctgtttcccaagcaatcttttttagatcctgcaaagatgattttctattcaatcctctatcaataagcaaaactaacttctgattgtttgtttcatttttgatctcttgctcgtgacgtctttggtttgtctccagcttttctatactagccatgcttaaagtcttccgaacatctctttcatgagatcttctttcttctgtatcttttggaggtaaccaacaaggtctagtactagaaatgatggacactttatcgtcactgacaagttttaaatcttccataccttcaacgcttgcattcttgaaatctaacggtagaagttctgctgattgagtacgttccaacagcttagacttcgttacctcgtattccgatttctgataaacagcgcttagattcttgccaacttgttggaagtattccagatctgatactttttgtactccggggattggagatggtggcatgtcgtgtccatccagtagctttgcacttctaccaacattaggtacagacgctctgtgtttccgttgcgaaatgaaagttgaactatgtgatgcagtaggtatactccaaacaagactttcatcaagaagatcatttgctgggagttttgcgtcctcatcgtaaaagagttctttttgttttatgctgtgttgtaaatgtagtttattctgctctctacgcaatctataacgttgtgatggtgtcaagggtttctttccattcaatgagtctgaaggtaaagccggcacacttttggaatgaagtgaagtggctaatggatgtgtattatgcagtggttgcgattggccatgtaattgagaatgttggtcataactactatgcatggctgtaggatttacagttgaaaacatagatctcgtaagtttgggagaagagtccacactttggaaggcatcgggtgctacgcttttcccctgagatccgggattattgaaaatgtacttcgtattcatcgactttggtgcactagcaactttcactgtcgttacagataaatcagcatcagaaaacgacgtatctgttaaatgagaaacatcgtctaatccgtctgtcaccgaagaatgtggtgtaacagggttttgcttcacagaggaaaaagatttcttccctcttggcattacattagcgctaactttcccgtccaatactgcactttgctcagtatcatggttttcatcgtcatcatcatcgataattgaggttcccctggacgaatccttagaagaaccggcattaatagagaatacatcaccttcggtatttatggagtcgttagaaattggtctctcattcttaatcaacactgcttttctatttggaggtttgaaagacagtacatggtctgactcttcggagccatttgcagaagagcgaggattgtgcgtttgatgttgttgttgctgctgctgttggttttggttttgactctgtttcccttctgccatgtttagtagcatattttcgctgggtcgtctagtaattcccgatccaacagtcttactatttgaactattggtgtaactagaaatcgacgatgcattagctgaagaaggtacctgagctgtagtaggataagttccagccttgcgaggccttgctgcaaccataatttactcgtatcagaaaaaaaaacacacccgctactgactgagggatctgacgagcttgagacagcaaaaggatgaactatattaaaggccaatcctaaacaggaaaaaaaacaaaaaggtaaatctatgaagggccgttacctatgaagtatcacaaaccagcttactgagcaaacaacaaaactaaccaaaccgaattctaactcaaacctagttacagcactctgattgtaattagtatctgtattaccgttttattttttttttgtattttgtttctcagaacacactaagtaatgtcctggttatagttatttcctatttcaatacagtaactgaattttcgacaatagaaatgaaacaaattgggagctgagctaaaaaaaacaatccaaattctctatgtccaaaaaaggagaatacgaatcaaaaaaacgaaaacgagaaacttcgttgagaaactttttctttctccttcctgtatatgtgtgtcacgtgatataagatcagaatatctctcaacagtaaaagaagtatacgtaatcgcaggagcgtatctggaattgacgatatgtgattgatacagttttcaatgctatttggtttatatgcgtgtcctgaaactgtgtcctgaaactgttctctcttcttgtcccttggcttggcggtaaacaaaattacaatcgatgagaaaacaggctttagtttattatttttcttttggttttatttcttctaccttttaaagcaaggagagatagagggaaaagttggaagtaagaacgagaaaaaatggaaaccccagaaatagaagcaaaaattcttagaagcgtacgtacagagaaatattataaacaccatttacatacagtttgcacgtttgatggttttccaatacatcaaatacaacaacggtctgcattactttatttgaacaaaagggtttaaacaaagggtttcttttcactgcctaagatgtttctcctatttgttagtatgttcaatggcaagtcccctcacatattgatacaggttggcttggttctagcggaatttttgattgacacttgaattttttttttttcgcacggaaaagatgcagaacaaaatttgaaatcttactgtattccttttagggttgtttttgtttgtttgctatttgcgtttgttgtttgcattcgtttcaactgctacattccagaagggaagaaataaaacctcgaagcgcactgaagactttttatatttagatcttgtatttattttttggatttcgtacttccagggttcgaaccgtggatggtatcattatattataattatataaatgtgatatgtacgagaggctttaagccgcgccgccagttactcttctggggaatcctgaggaagcgagctccgtagcgtttgttctatcaccgtgagtccatcttcgaacatctttagtaaggagtcaagttcagataacgcaataggtttcttatcgatacgatgatcgtcatgtacatctatgaacatgtccatggataatgacttcggaggtggatccatgatgaatcctaaagaagaaggcgtcgttgatgaaagtgcactcattgtagaaatattccctccggcgctgccaccaacgacggtgctgctaccagcagtgcttgcagtgttactggttcctggtggaatactcaggggggtcatcgatacggatggtaggggtcccgccgatgtggaagctgaaggaattgatattgcaccattgctggtaccgggattggttgagctcactgtcgtagcgagcatacttgcagtagttgtggttgttgtagcggcggtgccagaagcaccattgtttgttggcccatttgtcgccgaagcgctattgttcccattgctggctagaatagcattggcggggttgtatacatggtcattggtaatgctactatttctactcgatgtgctggcacttgtgcttctctttcttggttttgtgaaatctccgaaccgtttttcgcccactggtgtcattgccacagatatttgggcattgcttgtgttgataccaaactgatttacagtttgggcagtgacggcgcctggagctgtggatgctgaatttggttgatgttggtgtgatgcatcgtcaagctgcgtcgttgaatcaagtagtttgttggagcctaccagcgtagtaggagatggcatttgcaacttcaagtggggatgttgctttttgaaatctctattgatcctacttggttcaccttcggtttctttcttctctgctggggtattcattgattgtaataaaacatcattaggtgtatgcatttgcttcataacaggcggagtgttgctataaacagcactctgatgcaatacagaatctaacaatttcttttccggtgaaacgtcagccaacgcacgagtgggagacggcgatctcgcctgagtcaaattcgatccgaataaattcttagctcccacatttggagcattgttcgatgaagtagaagggacgttgattccatttgtgtcatcgtttcctggagtcttagaattggtatttattccattcattatgtccgacctaagagacgttagctgagaagatggttgtccgctcacagtgggacgtctttgtaatactggtgtagctttttgagacatcgaagagacagtggaggaccttggcttcgtattcatcgtcaaaaccgattccttacttacaggtaattcttctggaatttcaatttctatcggtgttggtaacactgatgaacttcctgggccagcaaggttggatttaaagttggtttggagtatggataatgcaggagtactttggctgtgcaaatttctcatatcaggtctggaatcgttgtcatgatcaacatgaggagtcccatttggttgaatattgaatgaggacactgtcttactcagcttgggaaaatcatacacttcttcaggcttatcctcaaacaattgtaataattgtttcgaagcctttgtttcgctccgtttagaagtgccatgggtggtagttccagtgtgacgacttaaatgatttgctgtacctgttgtagtgtgttgataatgcttattaaaatgcgtattatgttgatttgtaggcgccgtagcattaaggttggcgctattattgttattagcttgtatcgttgacagatgagccgtattgggattgttgttaaaggtcctgccaatggtggatccttggtaatatgggaaatatggtttgttggaattgtagtattcttcctctggatatgcataatttacttcttgaggagaatacttgatccagtccgcttcttctggtatagcctccacgttgatatcattctctaaaatgtattctctagagctcaatgaatcaaaatcccattttatatctatatcttcgggctccttttctgtaaatgaaccagcatcctgtgatgcatttccctctatcgatgaattgggattctgtttagaacttgtatgagattcttcctcatgtttatactgttcattcttttctctgaaaagcaaataccgtgttataagctcttttaaaatcaccgtgctggtgcccttctcttgttttatcaacttactcttgaaaagttcttctgcatatggcctctccttaggatcttcgtcaagacataatgcaataaactcctttaaaggctgagaatattcccttccctcaagtcttggcggtttggatttcgtaatcatttgcattgccctgatagcctccatatgacagtaaggaggatttccagtggcaatttcatacgcggtaatacctaaagaccatatatcaactttggtatcatagtaaacaccttccataatgacctctggcgccatccaataaggagtaccagccattgtttgtctctttaacattgactgcgagagctgtgcggcaacaccaaagtcacaaagttttacgcttccgttgtttgcaatcaagatatttgcagccttgatgtctcgatgaatgacgttgtccctatgaattgaaatcaaagctacaagaatctctctcatgataactccgatatacttttcttcgatgatccccggtcgtagcaacgtccgtagtgaaccaccagcacaatattccattataacccataacttagtatcaattaaatatgagccatagtaatgggtgatgttcggggtctgcttcaaagacgataaaaactggatctctttacggatatcttccacttcatcttcggtattatcgagatttaaaaccttaatagcatacacttgttgcgtcttcacgtggaacgccttatacacaactccaaacttccccctgccgatgatttccttcctcttgaaaagagatgtgacattattcgtgccgcttgtagaactactagacatcgtacctccaccacgatgagtttaaatccacaaaatacaaatagaaaagctgctagaatatttctttgtttgtatattagaaacaactgggcttttgggagggcaaatagagctttaatccctgttcttcttagtccagcttccgcttccctcacatgcaggttcctaatcccatctctcaaagttcattcttttataaacaagaaaaggtgggttaacgatcttcaaaatagttacccggagttcgttattcacgtgaacaatttttcccgttcaaatagctcgaaatcgggcattgtcaaggcaaggagcacttccgaaggatagctgtgcaatctgcgtttatggtcaggagttttaaaatatgatatgtctccacaaatgatgaatctagttgtttatggtgtgctagaagtgtttattctcctgtttcttgttgttcgatgggcttttaacatctcttttgtttggaaattttgatatttctctaaaatgaagatgcgatgcaatgcgctgcgatgcctacaaagaatcacaatgatgaaattaatcttgttttattaatttatcgagtactttagctagcctttctccgccatcccgatcagctgagcgaagtttgctcgttttgttgttctagcgtataggataaagaatgtttgcactttctaaaagtttgaggcagatcaaaaggcagaccatccagtatagatttatatctggtatttccaaggatgaggtgtattgtattatagatactataaaatccagtcatgaatggcataaattaaaacaagatcagaagatgcaggcgtatgtggcggaggcgttaacaaatcccacttcagagaacgtatctgaattgatgcagctgaagagaaaaatgatgaggactttgaatgaaaactataatttggccctgggatatattgaggaaggcttaccaggacctatagaaaggctaaagtttcgttcggagtttttgagggtcgtagactccgaacactatgcatatttttcaaagagccttgatcatatacggtattgcaaaggtcttgatagagcaactagaagaaaagaattttacaactgcattgagttacacaggagatgtaatccagaagtaacagaaggttctggtatattgctaccagatgatattcaccaatggtttttcgtatttgttcctcctgatgagagaatgaagcactatcttttcctcatcgaaaacaatgtattaatatcaggtcattatgcaggactgacacaagaaagaatgttgaaaggttcggagatggaatatagagtggctagcttccttcactttattgaggatcctgaaaaacgtcacattttcgatgaaaaatttagtgtcatgcaccctttccgaccaatgagacgaatcgtcaacctgctcataacgaaaaaagacatggtacacatcaaggaatatttggatgttttaactactagactggaaaatgtggaattgagaaacgaacgcattccttacgatgtacggaaattatattttattgaatttatgcacactttacagcattttgctagatgtacgaattatattgacatgttcttggaaacggtgcatagcatgatggatgctttacccaaagatactcccgtacccttcattcgaaagtcgtttgttgaaatactcaattattttcaaagaattggggatacagaaactgtcttcaaaatcatgtcaatgttcaatgaatatcctttgacggaaccaaatacgaaattcacaaatgaaatgttaggtaggattttattttcgttgaggcagtttaaagaccctaagcttacggcttcttatattgtgatcgcttacaagtccatcaagacaaagaaaatgttgaataatcttggcttgtggtgtcttattttcggaaatggttttggccgtttgaacaagaaggcgattagagatgctaagcaacctgaaaaattcattaatttaaacgtcccagaaagcttaagattcaaacgtgcaccagattccgtcgcattaaacgaattatatattgtagtctttgattactacaaaagcaaactttcacctgacgagtacagagagttagtggtaaaatgttacaagtattattgtgatttcttgaaaaatcatgttaatacttatcttcaatggagaatagacacaagcattttgagaactatgattcaccgcgccaaatttgatattaaggatgatagacttgcatatgaaatgttaatgaatttttatgcaatgaatttgaatccaagatttgattctaaaaacactccatttggtcttgtcttgtaccggaatgaggcaataaatcaacaggaatttaatcaagtgcttgaattaatgcaaagatgtagggcaccaatggatcataaaattattattaccatcgtcttgaaattcattaaatcaggcaatatcgacttggcacatgaatggtatactcggttacttaagacaggatatccactccgtcatttcaagatgattgaagaagctaaaagactgaactgggatatacctgaaccagcagaaagatattatgaagagtgcgaacgaaagaatcaactggaggaagagaatttcgatgacatctatttacagaatcctgcagaagattcgtacaccaatgacctcattgaagctgcaaagaaaataggacgcatatatgcaacatctattggtgcccgtataattcctgaaaatgataaagctgccatggaactgaaccaaaaaaaaaatgcatacgggacgtgagaggaagacctacaatcaaaacaaacttcagaagaatctagcaaacaaagtcaaaagtaaataaatgttaactaacaaaatatcacccttgtacataatagtaaatagtactaatagatcaatgctggccaatggctaatggtttgtatgttcgtctttaatcttaccctctttgtgactgaaccaggtttttaacatcttcgagccttgacataaaaatcaaggcttcctcaacagagactacttacgatagtattcggaaaaacgctaaatatgtacggatagcaatgcaacccagcttcatgaccatgaatgaattaatagtatttgccttactactgaccccgttgttagctgcaagacaacaatctgttccagggctactgttctcgtacaatctgtaagttgattttaaagagttattagcttccaagcttccatgcggtttgtataaacgctaaaggaaccgtgcattgaagacatatgatactaacagttattcggaaatttcagagcgccggggatagtaaaataccaagataagtatgacaatgcacaactaccacaagatgattttttgaaagttgccaaggatttgatctcacagtgtcattcggagacatatgtatttgtaaaccaaccaggtttaagtcgaagtgatttcaagcagcataagcaatctatgcacaaattatacaactatgtgctaactagttccacgacagtgaaattcgaaaagattgatatagtccaaaacgatgatatttacgaagaattgatcgcctatacaatggataaatgtaatattgatgataaaatagatataggtggcaatgtcacagacaggtatcaaccatttgtggaggcccgaactagagttctaagggtagacttcccacctttaccgcagcaaggacaatacgtagagggcatcgggaccagaaaagatgtgttgcaagccaatgatgaatacttgagatatgttatgggaacgttaccaaccccgaaacatacagttttttatatgtctttggaaaagagtgaagtgccagataccgagacatctttatcgtatgatatctggcctgaaatatttacgaatccacaacgaaaggttgagatcgaccgtaatgatagagttgctaaggaaatgccaaaacttgtcccttacagaccaagaattgatactgaagatgacaagtacttaacagtactggatcaggaattcatagataatcactacggcatcatagtgcttattattggcgtgacaattgcatttattctactacaattaggagccgttaaggtcaagaaaccgtcaaagccacaaataactaaggacgtaacaaaggaaaaaaagacccaataattctttattcctagattagtgttaaatatattcaagtaatctggtgaaatactactgaaggtcttaacgcgcaccttcattaagcatccttctcatctttcctcatataaatgttttttggtatatttttttaaggcttgcatcaattacaaaattagaacaatgaagataaaaggttagtcttctacaagcttagtccagaaatgaaggaatctgatacgcattttgctgctaccgcttaggtgaattcaagtgaacctgcatttgaacagtatagaaatatgtcagattcacccaatgaaattcttcaatatagggatagtcctgagttcgaagattgctgcgatgctatatctcaagatttatttgaattgaacgggagcctttcaactatgaaccactttgtaacggctttggaaacgaatgtatcccacggtaaatctaacactaaagttatcgacaatatcaataagaagacggttgaactaatagacaaaagtacaaaattagtatcatcgataaacgagaatattcataaagttaatgagttagaggagtcggctttggataagcctcatttgatcacaagggagaagttgactagggatgcgaaattctctgtacaggaattcaagaaatatcaacaacattttcttgaagttacaaagcggataaatgacatggccaaagtggctttggaagatgaagaacaaaataattccttgatggatactgttttaagagaggaagaagatgaacacgcaaaaagaacacaggtggttatagagcgagaaccaataaataatgaggaatttgcataccagcaacatctgatcagggaacgagaccaagagatatcaaacatagaacaaggtataacggaattaaatggcatattcaaggacttaggtggtttagtgcaacagcaagggcagctagtagatagcattgaagctaatttgtacaatgtagaagataataccagaaatgcagcaaatgagttatctcgcgctatgagatccggacgcagttcaagtaagctaaaactacatttccttttcatactattgtttttccttcttctcacaatactggctgttttcagttgaatgaatggtattcatgaggcgtcatggatgcctccattttatgtaatttttatgcaggttatactaggttacaaatcagatattgataaagtccggcaaagaagctaattctcatcgaatttccatacgttaacatgaccgtcgtcaccagcagttatcaataagatgacatctttagagccatactctacccatttcaccatatttgtttcataaactccgtgtgttaattcgtgaatgcactcaactatccagccatcttccgattccttgtatataactagacgtccgtcagaaccggtactagcaatataccccttaggactccagttaacactgtagactgcccttgtatgagccttcggtagaattgattcttggatccattcttgctcgtattctccgttatcatcttcgagacaccatattctgacggtcccatcatcgctaccactgcatagcctgacgttggaattagatttctcgaaatctgaagaccacacagtcccttcatgcccgttaagtacagcacaacattcccaatcatcatcacaatccttccaaatacgcaccgtgtcatcataggaactggatgccaataagggaagcgattgatgccatattacgtgctttacatcttgtgaatgttcttgtagaacactgatacattcgaactcttcgcccatttcatcagcttcccaaatccaaacgctcttatccctcgaacaagtagctaataattcaccatcatgagaccatgccacacatttaatttcattctcatgaccctctataatggctaataactccgtttccagatcattctcatcgttgtatccatcatcgtccttgccccaaatcgatacagtggaatcaaacgaaccagcagccaagatattagaatgaggcctccacgcaacacttctaacagtcttcttatgtgcagtatcatccaattcctcgataatttgaaaagaacgtatatcaactagtttaatctttctgtcggtacttccagttgccataattccaccattattaacgtcgacgctccagcacttatcatcatgcaatgcaagcgacttcaataacttcaacccagccatcgttcagttctaatacggcacttatactaattgcaggtatccttgttctttggattatcaataaaacaccaagtgtgttatgcatatggctactatcataagtttggatctctttgtcttaattattataagttcttatatttcaaatcttttcagatattgcaaggaagactcatgcataaagaatcgatacatatgaatgataacactggcataattgacctggaaagtcattagtgtggttcttcaataattgatactctcctttgatacgccaaaaggcgattctaacctgtgaatacacgacatcagaatcttataagatgaaattgttacttggaagcatcaaaagattatcgtcgtcatcgaaaacaactctacctcaaccttctgctggtaagtcttcttcgctattgaaaacagttctgctactgtctggctctgttgcaatcggtgcgctatcatggaactactacaaggagagtttatatcaaagggagttatcaagggattacttctcgaagtacaaaatcagcaagaagtattccattgatcaggatcactatttgatcgaattgacacctttgaaagcacagaaggttaatctttggaaagaaatgaactcttcaaaactctggtcagtcgaagttaaacagccagagattatggttgttagaagctacacacctctgcctctgacaatcgaagaaaacggagccgttgaagtacttcgagatgaggaaaacgccagcggcgcattaactttctacattaaacagtataaacagggagaagtggctcgttggattaaccatctacctttgggacatgtacttgagctgcgtggaccgtttgtagaatatgaattccctgatactgccgatgagatcacgagagatagatcgttcttatgggggaatgaagattgtgtcaaagacaattacaagtaccaaccattcgatatattgttctttactggaggcacaggtatcgttcctttattacaaatgactttaactgagtcaccattcagaggtaagattggtgcttatcatagttgtaaatcacttaccgaattagggccgttgaatagtattctaacaaaacttcaagataacgacagaatcgaattacatacacatgagagtaaccggatttcgattcctttgcaatctgatcctgccatggaaggaataccttctccttatccatacggtggtaatgagccgtttacctcgttagactcaaaagtgaggccagttctctctcttgtatgcggtccaggtggatttatttccacggtttcagggccaaagtacgatttggtacaaggcccaatcaaaggaatactagctgctcgtggttgggataattcaaacgtatataagttgtcgtgacctttgactcgtacataaactcttctcatttgatagaacactgtaaataccatcatgtcagctgtatcggacattttttcagatataacgaaaccacacaaatacaacttagatcacagaatatatacatagataacacatggaacatgtgtaacctccactttcctgctgtgtagctactattgtgattactgagacaagcagtttttaggtttacagcaaatatcttgtcatgcttgcaagttctcaacttgttagaaataaaagtcgtattcttttcaagagattcaatagttcggttaaaacgactggattcaaattgagggaatcggatctgcccaagaatgccacaatattcagtttaattcaacctactggcaagttccatttaggtaattaccttggtgctgtgagggtctggaaagatattaccgatttaaaggacgatggaacgactctactatttggaactgcggatcttcatgccatcaccgtaccgaagcccaatgctaaagagtttcgaaattacaggatagaggctattgcttctattttatcaattgggatagatccagaaaaagctattgtattccaccaatctagggtgagtcaacatacagaattgcattggttactatcttctcttgcatccatgggttcgttgaatagaatgacgcaatggaaatccaaatcaaatataaacgaccagtctgatgatgctgctcttggagctattaaactgggtttgttttcataccctgtgttgcaagcagctgacatcttactttacaaatctactcatgttccagtcggtgatgatcaatcacaacatttagaactgacaagacaattgagtaacacttttaacaaattctacaaaaccaaatatttcccgatgcccacaacaatcttggcacctacgaagaagattctgtctctgttaaatcctgagaagaagatgtctaaatcagatactaaccagaattctgtcatatatataactgacgaacccgagataattgccaagaagataaaaagagcggtcactgattccatctcagatagtttttattttgatccagtaaagcgtccaggcatttctaacctgataaatactttgtcaggagtgcaaagagtgtcaattgaagatgtggaaaaggatattgcacatattaaagatcacaaagacttcaaacagcacgttacagatgtgttagttgaagagttggcaccttctcgtgagcaattccataggtacatgaagaacccagactatctacataaggtatcagaagatggtgcctcaaaggctcgtgaaatcgctgcgaaaaatattactgagattaaacgcatcatgggtttcctatagaatattatattctccactaaaagttcctgtatatacaaattattccataatcacctatagggagtcactaatgactcctaattcattagcgtacgatgttgtaactctttggacttgcctaatgttggcgcaagatattattatatctttgatcaaattgcgccttctatctatgtccaatggagaaaacttagtattggttggatcatataaccagcttagtgtttggctgaatctatcagtataacccatttcagctattctgatgcagtatatttttaataacctaattgcttcctctacttcctttagccggaacgaaacaagaatcttattttccaaatgagctaacgttatcatttcttcaagattttcgaagccttctttcatcaataaaacttttgcaaatctctgaaggtgtttcatgcgtccttttctagtgagctcgtcatttgttttagtttcgaggtaattaattatgctatttttgttgtttttgacttcttttgctaaaatatccgcttcagcattccagtatttgtctttcttttcatcgtcattgcttgtcaggtctactccagctgatgacatgaaattccagtactgggagccataaggccaccaagagtcatttattagcatccatgcctccatagcactatcgaacatgtacccatccccgttgctcaatgttacaataggaataccttgtgaagttactgcacacattgtaatgttttcagccctgctcaaaacatcgtctgagtagcgcagcattgggttcaataaagagtacacgtcattgatcggaaatgcgattttaccagtattgacattccagcagtacatctggccaatacttgttatgcataagagatagtcaccggaaccttcaagaaaacttactggtacaccaaggagcatgggcgggaagagcatttgcccagatattgacgtcacgtaaatcatacctgtatcagttgaccacgcccaaaaggatgatccagcgctacataatgtgacaaattttggtaagaatgtttgaaataactgtttgctggattcattatcctttctggttagagtaatactggttggcttctggtcgttacctaaaccgttcttgatatcaagtacgaagttaccttggctcgagtattgaaaagatgctcttattttcggatgagcaaggcggactttggagaatgaaacagaaggcaagaaaaggtttgtatcaaggaaatcgatttgatcaagctcctttttagccttcttattagcgggtttattttgagccagtaaaggatcttcggtaactggttttcgtttcaaatcttttggaaccatgtaagatggttggataaattccatattcgtacttgatatggtggtgatttctgcagctttaggttgcttttttgaattcgttgtagtttgctgtgctgtcttatttggtggcagttttgtatccggttcctcggcctttggtttgaaaggcaatggatctaaaagtttaatctctttggcagcttctgttacggcttcaactggcatgacatccccgagttcgttttcttgaaaggcgaaaattactaattggccgtcctgacttatggcgaaaagcccgaggcctgagttgtcccattcaaggtcagttatgtatgagttgacaactttagacgcatcaaataatggtttaatacggttagtattccaaacgacaacgttcccgtcttcatttcctgatgatgctagcaaattgaatgtctgagtgtcgttagatgttggagattttgtctttgaataaatccttggagaaaactttaaaatcttacaatctgcaacgtagccaaccaaagagagttttatcttaaatttttgaatcctgtctaaaagcacagctgtaggaacgttgttatgtagcgagttaatcatggggatcacgtcaccctgcggagacattgtcattctatatggtaacggattagtttgaacgaattgattgatactttgatgtagtttagtagtgccatgcgaatcatattgatagatttgtacagaacgattttgtaaaatcacggtcaacaattgtcccaatgggtctgtaattatggatataggttttgatttcaattctatcgaagatttcaattcccacgtctttgagtccattatttgaagagaattggctttacttaggctcacaaacaacaacccgttcactttatcgtacttcaagtcggtaatggcttcattgtccttgaaaatacctatttcacgagatttatattctgaattggaatctttattcaaatccaaacatgccaaaagatgatcagaaccgtagactaacctctggttatctaatacaacaagccaccgtccatcttcttgattggattctaataaatccaggctcattttctccaattccttcacttctttgacatctgtcttccctgttgccgcgttcaaaagggtctggctatcccatatggacagatatttcccgcctataatgtacaatttattgtcgtcaacttcacattgagttagctggccatcgtgcagtttacttggcaactttagtaacttcatgactaggtcgtgtattttatggatatcacaaaagagctgcttttaactggaatagtatatatacaatttggaaagcaatggaatctatcacgaaacaatctttaactttagattatacccggatctactccaatgaattgtcgatatcagaaccgcacgtatcccgatcactaagcaatccgattcgattggagtatactggtatgtttcttctgcagcctcaacacactatggatgaatcctttatcatcatgataaataatgttatgtttgtatgtgcatgttgattacattttcaaacaaaattttggaagaaaaaaaaataaaattctaaccagttaaacagtaggattgtgtggagtacaacaccttcaacgggcagaagctggatcaacagttgaggaattgaagattagccactcctaattagaacggttgtattgccttattcatcattatagctgaggagcctcattttttttttcctaggaggtttaaattcgatatctagaatcatcaggttcaataggagatgtcaattcctgaagagagtgtggagaccactgaacaaccggacgtagttatggctgatgctctagtagtaaatgatcaagatgatggatcggattcgggcgagtacgtggaatattggattgatttgtttcttgggaaaaaaggccatgaatatttctgtgacattgatacggaatacatcacggataggttcaatctaatcaatttacaaaagacagtatctaagtttaccactgtggtacaatatatggtggatgatcttgaagaaggcatcatcgagagcatgtcaccagcacgtttagaacaattggaaacggatacaaggaagctgtacggattgatccatgcacgttacattatcacggcgaaaggtttacagaagatgctacagaaatacaaagcggccgattttggaaggtgccccaggtatcattgtaaccatcaaccgctacttcctgttggactacatgacataccgggcattgactgtgtgaaactatattgtccaagttgtgaagatctttacaatccaaagtcaagcagacatagtgccattgacggagcgtatttcggtaccagctttcccggaatgttcttgcaaggattccccgagatgtgtccgaaacacccaacgaaaagatacgttccaaaagtgtttgggttcgatttacacaaacaagcacagttgacccgttggcaagagctacagaggctcaagctggaaaagcttttaatcacgaaaggcataaacctgaacgaaagtggaggataccagttctaattttgtcctataattgtatatatatatatatatatttttttgcaatgggattataaccgcatgctactagatagaagtgcagaacacgtcaatggggacgacccgaagggtcgttccctttatctttctttttgtcctattgagagtcacatgacctgtatgaaactggctcctctttaccttggaaatccggaaaaactttcgcgaaccaaatatacccgaaagtttttccaataattccgggtaatcatatgcctgtctccattttccgacgaacggagaggctttcaaacggctttgctttatacctcattcttacaaaagctacgtggtttatgggtgttctgcggaaactcatcatacactggaagctaagcaaccagtgtcggaggggaaaagggtccccttcgcctaaatttcatcggaaagtgattttgaaaaaagacgaagccagatatcaaagggaaaaaaaatcgtgaccaagaattcatgagaacaactgccgcgcggcttgccaaggaaatctaatccccatatatcgcatttctgacaccgagagaccgtattaactattctcatgcgcaaacggttaaaagatgtagaatttctacattgtgctaacatgctggagaggatagctccaaaaaaatttacccaacgcagtagtagcagcggtacacttgcttaaagcctaccagaaaatatgtcaacaaccttcagcgtcacctgatggaaatcgacgtcttgttttttttttcttttccgtatttttctggcagttgtcatggcatttgtttacttttttccttcgtacagatgttattatgactttgaactaaccgatttttcgattttcattctgtcacagcacgatctcttagaataaacacacaaaaacgaaatgaaagatgtgaaatcaaaccagttaagctgcgaataatggtaatagattccttagtcatcttcactatatcggtttattcgtaactagcggggtttctttcccctccatttcgaatcacacttcaatggtgttttgtttttcagaatatgcctctgtatcggtaataacagtagtgccttttggatttctgtttaaaaatatctcttttaagtgatgatgttcttctccacctgcatactataacatcgtactgtcgagtttacatagtagtagtatttttttcggttacatgtatatgagccataagatgtatataccgcacgtcctccgatttagatcatatataacaggcacgctctgctgcaccttgttcagaatataagcgattagggaactgactgtatattgcacctgccattctttttgaagcctcactcaccaaaagaaaggaaagaaattgaaaaatcgatttttgatcgaaatttccaaaccgaaaaaataaatccgaaaagttagagatcactgactgatataaaatagagaaggaccttgcatttaaagtcatcgcacagcaaggacggattctgtacagacaggaaaaaaaaatagaaggcataataactagtttatcagtctgaaagataacataaagcaaagcaatagtgaccatgtttgcgtctaagagtgttgttgcttctagcagagctttgaacgccggtgcgtcatctgctcgcttcgctcgcggtgctagatttttttctagtacaaaatcaatttctaatattggccaaaaagctgttgtcccagtaaagccatcgctagcaagaagagtggtttctaccactttgaaagtttctctagcggctttgttggctggtactggttacgtttcctatgaattgtacagggaagctaatccacctcctcaaattcctcaagctgccactttcgctaacggttctccaaggaaaacccttgtcgttttgggtactggttggggttctgtgtccttattgaaacatttggatacttctttgtataacgttattgttgtttctccaagaaactacttcttgttcactccattgctaccttctactccagtcggcaccgttgagttgaagtccattgtcgaacctgtcagatccatcaccagatcttcacctggtgaagttcattactatgaggctgaagccaaggacatcgatcctgttgccaagaccgttagaataaaatctgctactaaagaccatgactacgaacttgatttgaactatgattatttggtcgtcggtgttggtgctcaaccaactaccttcggtatcccaggtgtcttcgaaaacgcctccttcttgaaggaaattccggacgctcaagatattagaactaaaatcatgaataacattgaaaaggctgctactttgtctgctaacgaccctgaacgcaagagattgttgagtttcgttgttgttggtggtggtccaaccggtgttgaatttgctgctgaattgcaagattacgttgaccaagatttgtctaaatggatccctgaaatctccaaggaaattaaggttactttggtcgaagctttaccaaatatcttgaatatgtttgataagtctctatggcaatacgcccaagacttgttcgccatggaaaaaatcgatgtcaagttaaagactatggttaagaacgtcaactctactaccatcactgcccaatgtggtgatgcaactgaagatatcccatacggtttgttggtttgggctactggtaacgctccaagagaagtttccaagaacttgatggctaaattggaacaacaaaattccagacgtggtttattgatcaatgacaagatgcaactattaggcgctgaagactccatttgggccattggtgactgtactttcttcccaggtcttttcccaacagctcaagtggcacatcaagaagctgaatacttgactgaaactttgaaacaacaatacaagattgatcaattgaaatgggaaatctcgaaaactactaatgccactgaaacttctaaattgcactccaagttggacagaattgtgaaacaacaaaaacctttcaaatacaaccaccaaggtacccttgcttacattggttcagaacaagccattgctgacgttgctgtcggtgaatccaaatatcaaatggccggttctttcaccttcttattctggaagtctgcttacctagggatgtgtctctccttcagaaacagaatcttggtcgctatggactgggctaaagtttacttcctaggtagagactcatcggtatgaaatctgaagtggttaacgtctgatttctgatcaatcacatcctaattttttcttttttcttgctcccattgtcttatccatctacgctgaggagacaagattgattactgatcgggtttcagtcatttaacattaatattcattcaatttacataaacatcacccattaattaatttgataaataaaataaatatcctttccaccgcttttatgctatttgtcaccatgccaagaaaatatatatgtcctgttgtagcactgttcattaaaaagaaaaaattgacggtccatgatgcaaagggtttgctttaagctttttgagtaacttccttccgatagtaatagatgaaatattatagtaccttctatatcataaatttagggatttgtttttttgtactttcggtattgtgtcaacattaccgttaaaaatatgtgcatctttgtggcgaggaataaaaagaaatttaaagtttgacggcaaagaagcgtcagtttcctgaaagagtgataatatggtaagatacttcagaaagtgataggaaggtgaatcagttacactttaatttcctctgacaatctaacacaaataatataagatttcctcctattcaatttactacctgctcgtcttgttcttttgatcactttatcagactattctatttcctcaaaaggcaaggtcattgtgagaagtttacaatgcaaaaaatctatttgttttaatcagtaagattgggcaaattttcggccgtaagcctttacctgttcatttaattcgcataatatgcggagtcgtctcgatttgtcgttgtggcttttaggtgttttttcactcacaaacatcagacgacacaagacatttgaattcttgctattaaggaatggattttttcaaattagccattatcttgcatcaaattagcatcaacacagataacaaagaggaccatggcaaaaacatgtttactattagtattacacgcagagttctccatccatgagttttcattggatcatttataaatgataaagggagtacattataccatcctattctaactcaaatttttgaagaaattgcatgatcttcggtttttgctattatggaaacttttgcaaagcaaaccttatagcaggaacaagtttttactgttagcctatcgtgtttgttcagacatctgtattctttctaaaaaaagaacagaaacaaaacgcaactcttcctgttccaaagctgcaagtattagctgtctaacacttatataagtttggttgctagtctacattctcttagttgaatgcaatcgttttactcaaatttgatttgagaaaatcgatcgttcttatgcaagtgacgcgtgtttttcgttctgtgcataattatcgcgtagtattttttttttttcggaaattttctccgttgtaaaagttaacttcataccgttttgaagtagaaacaactcctcttccgtgtcagtgcacacacatctgaaggtaaccgttttcaactgaaagcattatgtcagcggttctgtgttcaggtttgcactacaaatgtctttctcatatttggcaatatccaaatgcaatcccaagcaacctaacaccagaaaccttgaaacgaatagaaataactttacaaaaactgtaattgatacaggtacattgatgtacctgttttgacggaatgacataactcaattcctgtactaatcatggaattgagcagaaaattggtcacgtgatatagtgtccggtgaaggaaaccatggtgacacctgcgttcctctctcagcatatcgaaattatagcacaaatgaactgatgattttgtcggacaaacacttttgacgtctttgttttcattcacagtaagacacctgtgaaaaagtaaagatagtccgtttcgttcttattcttgaaaataagaactcgtcttactgtgatgagaatgaatcagtgtgaacaattctctaaaggtaatattttgttgcatatttccactttactgtggaggagatttattgacaaacttgattccaaactgtgcttcattgaacaacgctttttactcacgtcactgcttgtattttctctattaaatcagatactccaagataaagctagatctcgttataggtagtgagcagacggcgctaacgaggactggaaagtgattcgcacgaaataaggttgcaaattgggcagaagataagatctacaacttccagtaatataatggaaactctattggaaaaagacctaccggaaggtaaagaagagcgaatcaggctggcgttggattttattcgggaacaacatagtaaagaagggactgataattcagagcatgatattaagcccaagaaggacgtgttgaaacctagtaaatatggtaaaaaacgaaagcccacaatcagacagattgcactccattttcaaatacctaagagtacgctatacgataggatgaaggcagatcaaggacaaaagaggcaaagaacgataactaaggcaaacgccgctggaggccagagtgatgaaatctctgatgaaaataatgaacacgatttacaaatgcagttaagaaatcagacaacgagaacgtattctcacttatctcaaatgagattcagcccggaagcagaatccgacatggtgcgaaatatgcagggttatgtattagcttatggtaatctgccattgatctcagatttaagagagtgcatacccagcacaacaagggcggtacacttgggaaataaatggatcactggtttcataagacgacatggggaagaaacggtatatggtatgacgggcgagggggtattgaacgctaaatttaaagattttaggcaatggaaaaacaagtttagtcaattgcatgatttattccttcggtgcttgcaatccaaattaaaaagatgccatcagttttactacatctgtaaatacgttccacatggctcaaacgaagccaataagatgatattttttgcattaaaagtgaagattcagcaggtaaatgctggcacagagaaagatgtgacaatatctttgctatgtgaaccaattacaagggagttaagtcccatctctcctgaagaagcaaaggaacaattcttacaagatctaaattccattttgaaacgtatagacgctaactctacggacctagtcgttttggaagggttaacacagacggaacattgggactggtcacaatgtctagaattagtcaaaacgcacaagctaaacggtaaattgtatacggttccctggggaaatgacctactcacgaattgtttaaacaaggataataatattgcggtcacttttgagaaaatcacacaagattcgaattcagcggtggctaccaaagatatggttaactttacctctgtgtctgtcatgcttaaggaaataatcaccaacgcaacgccgttaccagccgttgccatcaataattcgcgcactcaaagggacgctatacggcaattaattcgaactatatctgagaatgagtcgcggttgtatagagaaatacatgatcctgatgcccgtgtcactctttgcaacattttcaatcaagcgcgcttacttgaagagtcattatctacttgcgctgttgaactcacgtgacttgttattgtcatttctgcatttaattgggttctagattacccgcattatttcacgtgatcaaccaatgtcacttctcagtggcaaaattgactgcttacatgtagtacgtggtatcactcctgacgacagtgaaatatatctgttttaacgacgaaatgagaacgtaagaaaaaaacagcgaaaggtaagagaatttcaaaacaataatttggcatagattatgaagaaaaggtgcgtgttgtgctctgacggttgttaattgaattaaggatttatacgtgtttaatctaaggatagaacttgttgagaagcaacttggtattgtcaaccacaaggaagaagacccaaccgaaacaatgtctcacgaagcagaagaggatttattggagtattccgataacgaacaagaagttcaagttgacaacaaggccactgaagtgaatgccgagggtaacggtgagagccaagcaaaggattctgataagaaaggttcttatgttggtattcactccactggtttcaaggatttcttgttgaagccagaattgtccagagctatcattgactgtggttttgaacatccttctgaagtgcaacaacataccattcctcaatccattcatggtactgacgtcttatgtcaagctaagtctggtctaggtaagactgctgtgttcgtgttgtctactttgcaacaattggatccagttcaaggtgaagtcagtgtcgtcgtgctatgtaacgcgagagaattggcttaccaaattagaaacgaatacttgagattctccaaatacatgccagacgttaagactgctgtattttacggtggtactgaatataagaacgatattgatttgctatccaagaaggaaaccgtccctcatatcattgtagccactcctggtcgtttaaaggctttggttagagacaagcatatcgatctatctcacgtcaagaactttgtcattgatgaatgtgacaaggtcttggaagaattggatatgagaagagatgttcaagatatttttagagccaccccaagagataagcaagttatgatgttttccgcaactctatcccaagaaatcagaccaatctgtagaagattccttcaaaatccattagaaatctttgtcgatgacgaagccaagttgactctacacggtttgcaacaatactatatcaaattgaatgaaaaggaaaagaaccgtaagttggctcaattgttggacgatttggaattcaaccaagttatcattttcgtcaagtctactgtcagagctaacgaattgaccaaactattgaatgcttctaacttcccagccatcactgtgcatggtcacatgaaacaagaagaacgtattgctcgttacaaggctttcaaggaattcgaaaaacgtatttgtgtttccactgatgttttcggtagaggtattgatatcgaacgtattaacttggccattaattatgatatgccaaacgaagcagaccaatacttgcatcgtgttggtagagctggtagattcggtaccaagggtttggctatctccatgatatctagtgaagatgacgaacaagtcttggccaagatccaagaaagatttgatgttaagatcactgagttcccagaagaaggtgttgatccatctacttatttgaacacttagatatttcatcatagcgttttacttcagaattttttaccaaaactagaaaattgcaaaaacaagctggaatgtgtattatcaaataaaatgtggtttttatacagtttaaaacgaatttccaatagtcccattataactaagtaacataattggagtataagtgtataaaatcaattcaattctcatgaaaaaaagcttcattgtatgtcgggtttaggtattagtgtttcctcatatgcccttgcagataattaaagcggagacgtctgtcatgaatataatataaactggatttatgtgatgtacataaggtctatcaagccgcttgtcagcttttacaggtgagaaaagtaaacatatgggcctttctggacaagcaggttacgctttctgtagtcgaaccgtgtcattggcgtggttcggcagaaacgacgtctgtttcttttatttttatgtgttattattgtcatttggtcttcctgcagacgaaaataagaaatagaataataactctggggtaaaaacaaataaagagtatgttcttacaagacatcctttacagtcccatctgctgtattaaaactccgtaattttggtagtgccgcacctttcggaagcgatggcctattgagatgcaatataggcagttcaggacgctctattttctgatttgaactgctgttgatcctaatcaaatgtgaatcaggtgtcacctctgataccgtactcagacttggtaaatgctgcgctgctggaactgatgcggctggagtcaccatgtttgctgttgagggactaagtccattattaaactgctggctatgattcacaagctgagtactatcatgagagatgtcagattcggtattatcaagattctctggcttgtcttcaattggagaatgttggagtgtcgacccatgaatgcttccattttccggattttgttcctctttaagaacctttgtagcaagtattcctaatgtgtttaacatgttggaatccgacgagtgtaactgtcttgaaataaatggcttcctgaccgatgcagatggcacggaagttggtctagagaggcgaggattatagacttggctttggttcaataatctggaaagtctgttgatttctttgtttttcgacatgatcgtttctctgtattttgtgatcttgaccgaagtaccctctaactgtctctgtaggtctgtcttttgtaccatcaaattgtatttcatactttcaaattgttgcttggcgagattttgttccacttggaacccgctctgaagttcgttgagattttgtactagaaacatattcttcaacgtcaattgtttggcccgttcttgtgatttggttaacgctgtcattaaatgccgtaatgaggtaataatgtcattgtttacatctttgtctttctcatctgcggtaccatttttcgtatcatcagaacccgtatcccctttgtgattcgaagcaggtatctccgctgtagattgtaacgcatttaaggtattcaaggttctctgagcattttctatagctaaacttacttggtcgttcaatgaatcctcctgcgtcgatattgacgaagtattcgaaatggtcgaactctttctctccaaatcgttaggcgtaaatatcacggacggtgaatgaacattatttacctctccctcagtctttaattgagtttctgtcatcccaaatgaagtgctagtcgcaaatattgctatgctctcaacctttatgtcccgatatcaatcttgaattactgttattatcgatttttcagcaagcaggcctgcctttgggaacttgtatgtttggtatgtatacactcgctgctgtaattaatactcgactgaggttggacttggtttgatagcgcgctacaccgtatttccttttattccctgatggtattttaaatctttatcattttaggattgtgcactttgacgcgaaacgacgcgtattatgaaatttcaagaatcacgttcgggaaaaagtacttcgggtttgatcaattgtgaagcgggcgaagtccaaacagagtcatgcgcaatgaaactgtatctgcccaaatggtcgcacatacggtcaagatcctgcagctcaacaggaacgtttcttgttcgtggagaatgcgccaaatatgtagaaattattggcgcataacactctttcattgtaattagctagttagtagatgggaagtggggcattggcacctaataactgtaacgtgtcagtatgtctgctcaatgactggaaatgaatgaactgcaaacgaacgagtaaggtgaaatattaacgttctacccgtgatattaggctatacagtatgtagatgtagtatatatgttgataatataagatacaatagaaaattgatatgatgatttccataggatcctgattaacggtaagatttttggaatctagatctagcacctctaccaccgaatttctttggttctggtcttctagaatcagcgatcaacaaggttctgtcgtaagaagtgaaagccttcttcaattcgttcttggattgttcatcgacgaacttttggtggtaagcaaccaaacccttagcgatagcttgtctgatagcatagacttgagagacgtgaccaccaccggtaaccttaactctgatgtcgatgttggcgaacttgtccaaaccaaccaataacaatggttcgtaaaccttgaatctcaagatttctggttgcaccaaggtgattggagaaccgttaaccttgatcaaacccttaccggccttaacgtgggcaacggcagtagcagacttcttcttaccaaaagtctataggaaaaataatgaggtaatagtttcaaaactgttagtaaaatacgtttttccaatgacattggaactgggaaagcccttgactaaaaacataggtgatgccagaaaggtgggtatttgaaccgtttcatacacgtcgataacatctttggaggtcatttgcttcttagttataaatagcctgaatatccttactggtgttactggtggtgaaatgattctgtcagagtggttttggatagcccacattatacaaatggtatattacggtgattccccttaatcaaatcttgtctggtatctttttaccacatcctgtttccttcggtgattctcattatatggtaggttcaatccacatttaatttgttcatgctatcacgagcaaatcggtcattgcttagcgatagaacttgaaacacacacgctcttgttgctacaattcatattacattcagaaagtactagtaaccattatttttttcactctcatgttacattatcatgttttcttcaattcgggattctcagttcgttccgcgctcgttcgcttgttcattcgttgttttaacatacttggacacttgggacagtagacatcttcgactttgcttgcttttgtctgaactaaatatcctaataacaacctaatcaacagtaaatcaagactatacacatgaaatacacttgttaactaccttgtaccatacaaattgtaatctctaattctttttccatgataattttcaaattctaacaaacttccaagggtagaaacctctcagccagagagaggtgggaaccacggtcgcctcagagtacaccagaggctcaccactatgctgagacggtgtgtttgggttgtgtccgaggaccttgtgaaactggcggcgcccatggtacgaaggttactacggatggttacctgtggtggaagaggaattgcctaggaacagtccatccccacctagagatagagtttccaggctggaattgcgaactggattcctgcctagagtggcggagccaccagcctgttgccagcaatggaattcggaaagagagaaatgaaccgagctcgtcgtagaccccgtttcgttcgaataagagtgtcagtctttccttatgagggaatttgtatttataacagtactgatagcaacactgttcaccacatgtctgggtgttacattcatgagacagtcccgatattaaccgagactgttgcatctgtgcaccacggtctatttatgttcaacttttatatctacttcctaaacaggaaatatctgatcctcatccaacaaaaggaaaagagtttcgcatcgaggagtctattgtcacgggcgtatcctccctagtcccaggcagaaacgcttcccgccacattgtccgctcttctcccttctccccaccactcgacaccttcttgcctaggctgggttggaagcagtagcctagcttgcactagctccagtctctccaacaccgtaccttgtactgcgcaagatcctgttcccttagtacggggctgtctcaacattccatcccgcctcgcggtactgggaattgtttctgttctgtttggcttcaatttcctagtatctcgatattgaattatggttattattattcaaaattttaagcgttaccagttgaaatatatatacagatatttaacagtagtattaggtggtactgttgtgttagcataagactacgttaaggtaaaccaaggatcaagtaacaatgggtatgtctatagacgtgttataaagagcaccaaccgaattgacgagattttagcgtgggttatacgttttatgaattaaataatgaaatgatgattacagataccgatacgaatatgggatatgtttgatataagataactgagaaataggatgaacttatgagattagcgtggttaacttctacggagacaaacgtattattattcacagagaaattccagatgaggagattcctgaaatgataagatgaatgaatctacacaatattgattttaatgtaaccagggacagaatatgatgaaaacctatattagctttcataatgcatcgaatagaatatatgaggatgaagaacatgaaaattcagagacagatttctcattttggagcactcgtaatcagcaggtaaattcaggagcacctatttgtgaagaatataaccgcaacgccgaaacaactcatctcaatggtggtttggtattaacttttttacttccaattgatgaatacattttgactaacaaactaacttaaaatttggatctctcggtaattatttatcgaaatgtttcattttgaatttttaaacagctatctccaagaacttaccaattttgaagaaccacttcagaaagcactggcaagaacgtgtcaaggtgcacttcgaccaagctggtaagaaggtctccagacgtcacgccagagcttctaaggctgccaagatcgctccaagaccattggacttgttgagaccagtcgtcagagctccaactgttaagtacaacagaaaggttagagctggtagaggtttcaccttggctgaaattaaggctgctggtttgactcctgcttacgccagaaccattggtattgctgtcgaccacagacgtcaaaacagaaaccaagaaatcttggacttgaacatccaaagattgaaggaataccaatctaagatcatcgtcttcccaagaaagggtaaggctccagaagctgaacaaactttgtctgctgctgcctctttcccaattgtccaaccagttactgactctgaaaccagagctgttgaagacaacggtgaatctgcttacagaactttgagattggctagatccgacaagagatacaagggtatcagagaaaagagagctaaggacaaggctgaagctgaagctgaaaagaagaaataagcaactccataccttttattcaaatactagacaaaacgttgttttattttataaatatcttttaatcaaattatctttccgtcattaagaattaatgtcaccgcatcccctttctcaataagtttcctgtttggtaattatgagacattgtctaccgtgtaaaaaaacgtataaactataatattttacatctaattcaaattatcagattatcaatttgtctaatgatattatggaaccttatacgatcctacttatatttcaaagtgtcactagtgatgagatgctttgaagattggacgtttgtgtattaaaaacggttgattatatatacatatttgtgtatacactcaaatgatgtgttatttgattctcaaatttaacgtagtaagtagtagcttaatgcgctagtaataaaaacagaatttattcctcctatgttaaaagttaacctaatttaatcgaacaaaccgaaacccatgtcatcatcggattcttccttggcttcttcttccttttcttcagcagcagcttcttcggcaccggcagcagcaccaccagtagcaactggagcagcaccaccagcaccagcttcgaacttgaccaacaagtccttgatgttttgcttagccaaagccttagcaaagatatcagcccagataccttcaactgggacgttggcagcttcagtcaaagccaacaacttttcagaagagacttcgatatcagcatcagccaagatcaaagcagcgtaagacaaagcagtttcaacagacatttctaatgtaaaatttcctggttctggcaagtgtagagataatcagattaagctcgtaatgaagcagactatttctttggtcctttgaaaataagagaaactaaataataaaacgatataagtaataagaatatttcataaaagaagcttcaaattgaacaaatgccatcatgtgtaaaacaaatacttttcctatcgaaatgttaaatggttactcctgtaagttttattgatatttcacatctcatcgtggaaaggtgaaaaatttcaggaaaagctgcgtggtttcgtcaggcatgataattcgtgtgatgtgatataatgtttctgcatgaaacgctggatgtacagagtcagcgtagatgtacaagggagaatccctgatattgagtcggagtgagtccgcagatgggtgctatattccacataatattctatgttttataaacatatatatactcgcgcgcagtgttactgatgagtgtaccttgtatcttaaggtatgatgcgaaagttatgggattgttaaaagatgcatgcaaagtgaagtaatttgcgaatgtgttgattgtatctgtcgttagtcgtgaaggtaatgaaggagacagcagtgcaggagaaaatgctttcagttcatgaaataagctccaaattaggttaatgatcctgcaaacttagtttgattgcttgttggagcatttcgtcatccagttcttctaatgttttctgacgacgttgaggactattccctccgtcagggcctccaactgaagaagaaatggatgcgtgtctagaagggtgttcgggatcaattaattgattactcatgtgtattgcagtagcttttgctgatcttctagcgagtcttaatctttctttggttagattgatctcccagtcaggtcttatagaatcggatgttatcacagacggatcatcggctgctattgagcccctacgaatttgttctatagttacgagttcgtcatcttcattgctgctagaatccgatactaggccttcacggtccttgtattcggcaatcttgtattcggaagcgtagatcccgttgattccagtccgcacgtccctgcgcggttcgtatgttacaccaaactctgcagtggcacagtaagggcaattggcaggttcactgacaagaaggttgggatccttcaattcgtccggttcttgatcttgagttggatctacctcttcatgcgggaagtgtggtgcggcacgcttgatttggacgaagcattcagtacagatcggttgcttgcaacatctggaaatattcaaaggcttaggaaagtagaggaaacatattggacattctgctccatttttgtacaaagtatatttcaaatcatcactgggtaaagccgggttctttgcttccgtatgttttttgttcataagtttcagctcaagataccgttcatttgccctctcctgccaaccaactcttttgaaatataaccttgccttagaaattttcgacctttgccttctttgttcccttttcgaagcggtactatccagtagatagtcaaattcgtcatcggctaaatcaccggtcggaactccctcaaattcttctgggtcctgttgaaatgaacaatgcaaaggtaacccatcaacaatttttatgacctcttctcgagtccaagtctgatcaaattcttgcaatggtgtgtaaaagggagccaacctcctttctataattaaatttttaactatatctgcttcatagtccaacttatcgaaattataacatccaaaaggtgctaaaaacccaccatccacagtttcgttgtacttgaccacaagttgtctagcatgcttctctttgagcttctccttctccttcaaagacttcttcttgtacggattcggactgttgccgttgtaaccgttagcactattataagagtctgatctcgctctcccactagcacttaacaaatttcctaccaaggaagtagccctcctattccggttaagattttttgggccctgagatccaaaatttaaagactctgaccgttgctgcttcctatttgcagggtcttgagggctatcaattttacctggaacatttcccatggctggtttagatattagtgtatatatccctctgtttctgatcctattaaattctgaggttcttcacttataagcggtaaaataatatctaactttccacacaacgctaaccggatactgtaacttctgaaacaatgtatacgcaatataactaacacaccttgttatatgactcagttaatctattgtatctgtgaagttagaaaaaaaccgttcctgtgttctccctatataatggagttttgtctcctatagaaataaagggacgtttttcttatgatggaatttttgatttcaaaccaatttattgctttatatagcgacaaagagaaaccagaacatttgatataacacatagtgaaagcctcctgtctaatcccgaacatgcataaaaaagtccgagtgacgaactgggagttaacaatctccaaccttgttcggtggaagatatgagatgtatatatgtatgtagctattatcccgaaattcatttcggtcgaaagcgtcacgatacgcaggcatatggcattaagttggaggtagagtaccggaaattctgtctacatcgggatacgcactgtactgtatttctaaagtttatggataacaatacaggagttttgatagtgacactgaaaaaagatgtaacttacatatgggtatttggtataatagtgtgactcacacagtgaaagaaaactaggttgaagaatagttggaccaggtttttggatagattcacttatcattccttattatttcttaggtatatatctttacattaggagcgaggcgaagttaatgagatatgagccgggttttcatcaatgctgaccgagcagaaagtaatgacagctgataagcttacagcagatgctctacaatgccgaaaaaagacgtacatatatatatctacttactgggccggaatttgtgagttactaagaaaatcttactacgttgatgttaatgtaggacccttaactcggccttctatttttgactttcctgctgatattttagtttcgatcactttgttaataatatacatttacgcgaataaaaacagcttaaaggttcaaagtgtcaaaaaaatattaggaaaaaaggaactgatttgcttgacacataactgttatgatgagacatggagttttaaagaacaagtacagagaagaggtggcacaatacgtctacgtatgtgccgttatatagtcgttagaatacttagcacagctgaagccttctcagaaatggccttcagcctttagtagaacggtcatatcatcaacagacttggtaactctttccacaatggtggagacatcgtcttcggtgatgatgaatgatggtgccaacaaagcaatatcaccagaaacaccgtcgatgtttccttgcatacccatgacagtaattccattttcgaaacatacatcttggaaacggtgaccaacgtcaagcttgtatgggaatggttcctttgtttctctgtccttgacaaattctaaggaccagaatccaccaatacctctgacatcaccgacgatgttatcgtaagctagcagagatttcttcaatttctgacccatcaagttacccttttcaaagatgtttttagttaaatcgttatccaagatcttcttttgcacaccaagggcaacggcacagttaaaaccgtgagatgcataagtgtgggaaccgatcatacagttcgaaccttcggcgtatgcttttttgatttttggaccaactaaaacaccggctatggtaacgtatccggaacccaaggtcttaccaacactttggatatctggggcttcttcagctgtcaagaaattctcccaacagttcaacttaccgttagggttgcttctaccagtaccacacatgacttcatcgagcatgaacacaacgtcgtacttattacagatacggcggatacctgatagatatccctttggtggtggagtagtacctaaggaggaacctggcaatgtctcaacgagaaccacagagatagtctctgggtcgttgtctaagatcaattgttccaggctatgaatcaatctggcacaatattcttcttcggtttcacctttcttcatgaatctgtatgggtagcatacaggcatctttaggcataattctttttggtccatcaagatttccttgaactgttcggctcttggattagaagagatggacaaggcacccaaagtgaagccatggtaagaagattctctagagatgatcttagttctttttggttggccacgctccaattggtattgtctaatgattttcatagcattttcgttagcttcagaaccagagcaacaccacaaagcggattcaaaggcgccctttggagagttttcaatgtagaacttagccaattcttcagattgtgaattaccgattaaagatgggaaagtgtaagtgtgattcttggctgcttctgtcatgatcccatggatatcctcatcaccccatcccaatgccccgacagcagcaccagtgatgccatcgaagacatcttcatgtaacttgccatctttttcaacgacaattctgcatccttcaccgcgtttgacatgaggtaactttttagtgatgtatccttggaagacgtaagagttattttcgttttcgacagtcatgagtatatctttgtattataataaaacttgtttgaggtttgagtttttgtttgctgagtggatgcaaagatgtaatagagaaatatgtgagttaacaaacaacgaataagtagaaccatccttctgacagacgccctttataaataaatttcaagactaatacttgcttcgaatcatcctattccctcataatggaacttaaagtaagcaaccggcaggagctaccttgtttagattatccaatgatatctgtattgcaatcgaggtatctacgcataatgcataataatatcctctcacaagcgactctaacaaaatgaattgtttacgatgtacccctacaaagcgaaaaaccgtctgaccatactaacagcaggaagcttagttgtatctcccctccgcatcagttcaactacgaactgaacaagatctaaagatacagtctttcaatcgttaagaacaacataaagtaaataaacagaattcagccttacgatcgctagcctattcccatcttagaataatcacgttatacattttgccccaagataatgtaactacatagaagtagtgccatttcatttgacaactgtagatcggcctaccgagaaacctgtcaaaatggatacccttaatcttagattaccaaattcaatccactcgaaaggattgtctaacgcggttttgctacgatagataagcaggaaaatactgcgcattgtgatgtctgggttcgtgtgtggaacgttccgtcgtgatcacgtggtttgtggcatattttcagttatttaatttttgcgccgtctccagtatcctctttgggaaaccttcaagttaagctaagctgcattcttttcctttttaggaaggtgtagccgttgtccaacattgcctatgcttcattccattctcgcaagactgatttccgcatctcatctcgcaaactgtaaaactgaatattttgtaaacctattccaatctgatgttcttcacgaccatgttggttcggtacgcctagtgaataggagcttggaattaatcacagtcattagaaaaaagagctttaaggcacagttatttgcgtttactggaaaactgagatttcaattaagtgacaatgagtcaattgaaatatatcttggacattgaaggtacggtttgccctatctcatttgttaaagacacgctatacccttttttcttgaaacaggtggaatctcttgtcaagactaatgaccctactttgcagaacttacttgcccaatttcctgtcccacaagatgcttcttctttgcatgaacatattgaatcgctagttaataacgacatcaaggattccgtgttgaagcaattacaagggtatatttgggagcagggttacaagagtggtgagatcaaggcgccagtgtatccagatgcaattgatttcattcagagacatgctcctaatgtttacatatactcctcagggtcagtaaaggcgcaaatactcttgttccaacacgtagaaggggacatcgatttaacgaaatccattgctggctacttcgacattaacacgtccggtaagaaaactgaacctcaatcttacaccaatattctcaaaagcattggagtgcctccatcatcagcaagtgatgttgtgtttattagcgacaatgacaaggagttagacgcagctttggatgtaggcatcagcaccatcttggcattgaggcctggaaacaacccggtatctaatgcagaaaaatataaagcgcttaataacttctcatctatataagacatgtctaaggtacactggttctctgaattgggactaaggatatagtgtaatgatgaataaatttaaaaaaattaatgaaggggatatctgattgattgtaacacaaatcctacttgaagttggaagtaagagatcgaacataccacgctccgtctgttgcagattgactaaggttggttaagtataactgctcattatgagtgcgtatgtgtgcaaaaattggaagatgaatatgtgggatgccttcgctgtagtaggaaaatctgacggtatagaggtcatacttggattggcaaacactacatgctggagatatgagtacgcatattccatattattaaacaaatttggtagagataattatttttgttttctattttgaacatattcttctttccctacatgcctaaagagacgatggtttattgaaaaatcatactacattcaatcagcgtaattgttgaatagcatgttggcagcaatttcttcgtttttgtcacatgcgaagtagatttgcaccaccaaggtcctctcaaaacccaactcgcaaagtctattgatagcttcttcatcttctgctgagatagtaacattgggaggcgcgccttgagtttgtcccccgaaatcacctagatcaccttctgctatgtcatctcccagattttcacccaaagaatcggttagggaaccgccaacagcttctaatagcaaagagataaacctttgtggatcttgcagcatggtctcacggagatgtgggtaacgcgtgcttagactctcgaaaagtggcattaaagcctctggacgcccagatacaacgtcacgaagttgtgtaatgtcctccatagtcaatccgattgtgcccatttcttctccacctaaaccagcagcggattcatgaccttgctcgccattattggcttctgcttgtgcaaataaattgtcttcatgttcagtgaattgtgatggcacgtctgttgcaacttcagaattagcattcgccccagcttcactagttacagcttcagcttgttgctgcgatggctcactggcttcaggaatacccataagcaaatactccactgcacggtcagggttgttgaatgctgctctaagcgcacgttctacttgttcacgatcataacccatttccatgattctgttcacagtctcgttacgttgagaaccagtgacaaacgaagcatcagtcgtcccttcttcttgtgtaactgcagtagtacctgttcttgtaccagtggttgtagcttccgcaggtgcatttgcaactgcagaagtttctgcagaagcagtggcttgagattcatcttggggttcagttgtggattcagttaccttaacatcagcctttttcttagttttgctaatcatgaatataacctgatccccttccttaagattgcatcctgatacggtcttaggatcctggagtatcttacctgcgtagatcaactttatttgagatgcatcgcactgtttttgttcagcgatcaattccttggcgtgtgaaatggtggcatcatccgccaattcaataggtagtttttcctttttgaaatctttaaaattaataagcattatgcttgtgattttcttggactttgtctcaacggttgttttcttgactttatcttctttgccacccagccatcagattcaagttgatttggcattaatttcaatttctttcactgttctcaactttcattttcgatgttgacaaaaaaaaaaactgaaggtatctgacaagatgcagaactccggaatacgctgaaaattacagcttaatgcagcttgataacgtgttttcagtatttgcttgcctgtaatagttaccagtagtaatatggtttgaagtaaacaaaatgaacagattattgcaagtacaatattagtatataatgcatttaaacgtaaatgtaaaaaaaagtctattgataaaaacctcgataatgatctaaggtgcatattgtacaactagatactccaacgtgttacagtctgcctaataattgaataataataggggatggaagcgatgagaattgaaattagatggttaagatatctttttaaaaaatatctcgttagtgaagaatgtatttgtgggttttataatcttctttactcttcactgcctaaacagaaaattattaatgagcaggatcaaagtccagtggtacttcatgtgaatcttgattatttcctccgttccttgaaccatcatctgcttcatcatcatctgaccagtccacttgaatcttcctatctaggacattcggatcaatgttcttcaaaatttgtaacctttctagctcccactcatctctcacgtcatcgaaaccaatatcccaaattctagcatagaactcttgaattttttgctcttcaacccgacgtttctcttcctcggccatccaggccatgtgtttcaaatcgtcacttgaaggttcgtaaatgtgccagatcacataatgaggtagaccgacaacactgtattgcattctacgtgataatttaccaaaggcttcagtttcagcatgtttctcgaaagagaacgcagggaaatgagaacctgttctaaagaccttagctttagataagatggaaacaccaccaattccgtctagttccatctcgacctcgggatcgccgcttgggtctctcatgtaggccaaatgtgttctccatgtagcgtattccgggtacccttctacgatacaagcatcttcatccaaagaatcagctaattgtaatccaccctcagattcaacccatgagttcaaatcatatggttgtatatttcccaaccaatcgggtagaggtctccagacgtttggaacaatgacgtctttatcatgatgcattaaatcttccaaaatagtattcggtatagtttgaacgtcgacatctctccagtacacgtaagaatgatacggcttcaaagccgctgacccaagccaatttctagctctggccatggattttcttctagggccttgagctgcaaacccgtgtctatcagaaaacgattgacccacactttgaccgaaatctttctcaaaaatttcaatgttagcgaatcttctcgatttgtcttggtttgattgagctcttctcaaatgagaaagaagtgttttcatggtatcatcgcttgaatcactgaccaaaaatgaaagatcaatcaagttatgtgggtatgtcaatttatccaaggtatcgaagaacatatccaaatgtgcggctgcatctctcaaaggaacacagaacaccaccctatcaccggtctgccatccattggcattcccctgataattaattaaatcgtaatattccactccaggtatatttctgaacctgttaccagttacaggacttgagacgaacggtacgaactgccatatgattgggaaaatcattcgaattataagaaaccccgttaccactgatcctatcacggacacagcagtcaaggcattgaacctgctcttacccttgctgcccatctatgacggttgtatgacgttgtgtagaatatttgaatttccaggaatcgagaatagaagtgatttcaaaagtaaagagcgatggatccggatgtttttattcctccacagctttagcgattgtattttattgttcgaagaaattttgataccgcaatttttcacaatagatctataaaatgcacgctcgtcaaaagatccttatgtgttcttcctttctcactaatcctgggcggtgctaaccctgtgtattatgacaccttctggaataataatcggctgctttaaatgacaaacctttttcctttagcgtttgcaacagataatatggtctgtgccataataaatacttataaaatattactattttcgattgtatagttgcattgttttcatccatttcaatttcttcgccaaaaaaaaaaaaaaaaaaaaagtgtataaactgaaatttggaaaaggtaaataaaaaggaactgccagaccctacacgcagttataaggtgtgggaaccagtgattcaactctcagggcactgttggggaccgtaagttgttgtagataagaagcaactctactttttcccggctcaattaccgccttttcgcactgtaacagaacctctactacggccattcaacataacggaacaaaaaggctggaaagatagcggatgtctgttcttcccgtacagtcacgtgacatgtttcatctcattccaatgcctgggaatgccaggcggcaatcaaaggaccaaataaatacgtgtatagtgatatgtatatgttacccgggcatcgttgggtttccctttttcctactgcttacgagaggattccgtgagcttaccgtgtacggtgatatatcatggtccgtgcctgtttccctcaatgcggcctcaggttctttggatctgtcgactggcgaatccacccagctcttcgccatcaaagatgaattatacacaactacgtatcaaaattgtacattatacaaatcgttccgcaaccgatacaattatgtgccaacgttgcctatattattgacttcgatctgtcagtgaatgccgttaaaaaactagaatatgccatttggaaaacatacaatccccatagcagactagaatagcaagggagaagacgatgggaaagtagaaaaaaaagacctaccgtacgaattgctttttctttctgttttcacactctacaaactttacacgactatgaaatacatcggtgtttttccctctcgctctctctttcactctctctgtacaaaatgatcgaaactaaatttttcaaactttttttttcagttcgacgacgagaaagaaaaaaaaatttgatattcgattttatatatattggaaacaaaattataagagtttttttcttcatggaaagttgaatttaaagctttttttcatttacaagagtgtatttagtccattttgtatatgtttcagaatgattttgtaaacttcttcatttgtttaattagtttttcttgttctcttctgttttaactttatcctgttattagttattcagttttacttggtttcaattgtattttgttttcactacagatagtagaccaaacgcattaaacaaatcacacatatacaacatggctgaagaagaacacactttcgaaactgctggagctggtgcttccttgactttcccaatgcaatgttctgctttgagaaagaacggttttgtcgttatcaagggcagaccatgtaagattgttgatatgtctacttccaagaccggtaagcacggtcacgctaaggtccatttggttgccatcgatatcttcaccaacaagaagttggaagatttgtctccatctactcacaacatggaagtcccagttgttaagagaactgaattccaattgttggatatcgatgacggtttcttgtctttgatgaccatggacggtgaaaccaaggatgatgtcagagccccagaaggtgaattgggtgacaacatccaagctgctttcgacgaaggtaaggacttgatggttactatcattgccgctatgggtgaagaagctgccatctccttcaaggaagctccaagatccgaatagattttgatatgaacaaaaaaattcagtaatatattaatggactaagaaatgagaaaaaaaagtttttttatccctggataaatggaaagaagaaattggatcaaccgttgttgatacgttgagctcctaatgtgttttgagagggacaggggatcttcttttgttatcagtgagattggactcgagatgaaaaagacttgaaatatgattccttttttatccttgcatgttttcacttgtccatctttctgtgtttccacaaaagtcgttttccttcctggaacggttttggttgctactcccggtgttctttagtacgctatctaattccccattttttttcgtctactgttaagcatccaattatatatattaacttatatgatattctgggtgttttacgtgggttttcagcaatgggatggattttgagttataattgttggttggagaacaagaaactgttttttcttttctggaaaacactcaatcgctcctttccttgtcaagcgtcattgatggaaatactatcagatacgttattctttatcactttctccttttaaatcagcttttttctctctattccagtaattttttttttcactcaattaaatatcattatatccttaattctatttcttatatatttaaatcttctttaacgcttccgtttgtcgttttacattgtcattgaaccctgttaatatggggtgtgtgtactcttccgcacttgcagactgccagttactaaacggttgggaaaccatccttgttttattttttcaaattttggctcatcgtcgataactttcaatatcaaaagctcaattgtaggcaaatatgatttcgttagattactttctttaataccatctaatgtccatactaggttcagaacgttggcaagggtctgtagtttcttcttgcactgtgaagcgcggtatagtatttattatttaccaattcacaatataatgagtgacatcttctggatcatgtgatatgaacctaacatcattttatcatataacatggcaacatggccgagcggttaaggcgaaagattagaaatcttttgggctctgcccgcgcaggttcgagtcctgctgttgtcgttatttttaaccccttcttcctttattttttgacgcgttgccatttctcattacccggaaaattattcctctttcttttccaaaaacggaaaagatattgacgaaaacatcaaatctcatttctctttgccgtattctgttggtaaaatacagctgaaactcgattctgacaaaaataaactagaagaaccatatcaagaacgtttctatcccagaacagcactggtgccaatgaaacattaatttttagcaccttcattttaataatattattgcatttatcgctccctgtttaaaggactttgctactgaaaaacaccataagtaccgaattcaatcatgagtgatgctatgaatcaaacaagtgatgctgtctttacagacagaatgcgaaggtttcaagagtttttggatacccattcgcattatactcgagaaataagatcaatactcgagtttaacagcaacgtagtgaaagagaaaaagacggatgatgattatttaaatactgcagacaaagatacgatggaccatgacactaatcaattgccattgagaataacagtatcacttgacgatttaagagaatttgacaaaacattttggactggacttttacaagtaccctcgttctttttaccaccagcggagcgtgctgtttcggagactgcaatggccttagatgatagccctctcgggtttcgcggattccaaaatgatcccagcagacaatggagactgtcattcaagggttctttcggtccgaattctttatcaccacgtaccttaaactcaacacatttgaataaattgatctcagtagaggggattgtaacgagaacctcacttgtgaggccaaaacttctcagatccgtgcattatgcccaaaccacaggccatcatcattaccgtgattatcgtgatgcgactacaacattaaccacatccgtaccaacaccagctatttatccagaggaggatcaagaaggtaataagctggtcacagagtatggattttgtcattacatggatcaccagcgaatcaccgttcaagaaatgcccgaaaaggcccctcctggtcaattaccaagatccattgacgttatcttggatgatgacttagtggataagacaaaaccaggtgatagaattaatattgttggtgtatacaagtcattaggtgcaggtggtctaacaggtggttctaataacaacgacaagggtaacggtgctttatctggtttcagaactgttgtaattggtaacacagtgtaccctctacatgccaggtctacaggtgtgtccgccgttgaaacgctatcagataatgatattagaaatatcaataagctatcaatgcatgataatattttcgacactttgtcccagtcgttagcaccatccatctatggccatgaacacattaagaaagccatcctattaatgcttatgggtggtgtggaaaaaaatttacccaacggttcacatctaagaggtgacataaatatccttatggttggtgatccatccaccgctaaatctcaaatgcttagatttgtgttgaacacagcagcattagctattgccactacgggtagaggttcctctggtgtcggtttgacagcagccgtcactactgataaagaaactggtgaaagaagattagaagcaggtgcgatggtgttggcagatcgtggtatcgtttgtatcgatgagtttgacaagatgtccgacgtagatagagttgctatccatgaagttatggaacaacaaacagtaacaatcgcaaaggctggtatacatacaacattgaatgctcgttgttcagttatcgcagctgcaaaccctgttttcggtcaatatgacgttaacaaagatccacataaaaatattgccctaccggattctctattatctcgtttcgatttactatttgtggttacggatgatatcaacgacatcagagatagagctatcagtgaacatgtcttgagaacacataggtacttacctcctggatatttggaaggtgaacctgttagagagcaaataaatctatcattggctgttggtgaagatatcgaaaacgaggaagaagatgatgatgaggacgtagttttcgaaaaattcaatccacttctacacgccggtgcgaagcttgcaaagaacagaggtgatagcaatggtagcgagcttcctcaaattgttgcgatacccttcatcagaaaatacattcagtatgcaaaagagagaattattcctcaattgactcaagaagctgtagacgttatcatcaaatcatattcaaatctaagaaacgatcagaacaccaagaaatcccctatcacggcaagaactctagaaactttaatcagattatccagtgctcatgccaaggtaaggctttcaaagaaagtagaactagaagatgcaaaggtagcaacacaattactaagatttgcattactaggtgaggacggagccaacttcgacgaacaggaatttgccgaaggcagaacaaccgaaaaatctccaagaaagaagccaagagcttctccaaggaagaagagaggggccgtttacaaagaagttgactcagaggatgcagaagaggaccaggaaatggcagagactcaaccggatcctgctgacggtctggaatctacgatggtacggttagcaccagaacaagaggaagaccttcaaagaagactagaacaaaacttgagagtgagtccgagacgccaactatcagtcgaaagaagagtactttcacaaagcgaccatcaacaacaggttctccaccactcctcgcaatcctcaactggaccccttgaaactggctctcaattggaaccgtctcatatgacccttgattttatgtccatcgaagagatggaccagggttcaatctcaaccggtaggttatcgtcactctcaggtattgttgcaagactcatgcaatcagacattttcgaggaagaatcgtatcctgtcgccgcacttttcgaaagaattaacgagcaagttccagaagaggaaaaattcactgttgatgaatacgttgctggtctaaggattatgagcgatagaaacaatttaatggtcgcggatggcaaagtatggagagtataatcttaatttcatttttatatcatatatacaggcttatcatcttgccttacatttgcgggcttttttctatgcaatggttttctctacgttatgtataattttctgcgcttttagatgaagttgactcccagggaatgtatctcatccattatacatatctcaaatatcgagttatcaataagcaacgtgtttgttcttcttacactgtcgctgtggatgaaattttgttacccgaaattttacttcagtctttgagatttggtggcaaaatctaattttaacgtgtatgacagacaatacgtcgaatatgaaaaaaaatgcattgacataatgctttgattcaaacctttaaaagataccatttaaaagataccattgattcataatacaatatgtttaaggttaatttaacagtgtttgcaaagtatatagagtgaccaaagacgtcaagatggccgataagcaatatgtggaaagtcctttagtgaaggactccacacctttggctactaaatcgttttcgatgaggccatatgtcttgcctttcattccgttgtatgcaaccttcctccatatctactacactcagtatgatgtgtacatcaagggtcctgaatggacatttgttttccttggaactctagtttctttgaacgctttaatggctttactccctgaatggaatattgacatagccgtttggtttaactacgttcctgttaaattggaagaagcaactcacttgttgatccacaccactccaaacaatgggtcttctggtatcgtagagattcaaagagctactgaaggtggtcatttgcaagtgttctttcagttccagaaaaagagatttttatggcatgaagagacgcaggttttctcttcacctaagttcctagtcgatggttctccaaagatcgcagaattccagaacagcaaaggtttgaatggagatctaacccatcataagagattatacggcgagaattcctttgatattcccattccaactttccttgagttgttcaaagaacatgcggtggcacctttcttcatttttcaactcttttgtgttgccttgtggttgttcgatgatctatggtactactcccttttcaatttgttcatgatcgtcgctatggaagccacttcggtgtttcaacgtttgacgactttgaaagagttcagaactatgggtattaagccttatgccatcaacgtattcagggatgggaaatgggttgaaatgcaaaccgataaactattccctatggatttggtttcaatcactagaactgctgaagatagtgccattccttgtgatctattgctaatcgacggttcttgtattgtcaatgaagctatgttatctggtgaatccactcctctattgaaagaatctataaagttacgtcctgccaatgatcaattgcaattggatggtgttgacaaaaatgccgttctacatggtggtactaaagccttacaagtgacggctccagaaaataggactggtgtaattacaccaccagatggtggtgcattagctgttgtcactaaaaccggtttcgaaacatctcaaggatctttggttcgtgttatgattttctcagcagaacgtgtcgatgttggtaacaaggaagctctttactttattttatttttgctaatatttgccatcgttgcttcttggtatgtctggaaagaaggtaccagaatgggtagaattcaatccaagttgatcttggattgtattttgatcattacttccgttgtcccacctgaattgcctatggaattgaccatggccgtcaacagttctttagcggctttatccaaattttacgtttactgtaccgaacctttcagaattccatatgctggtagaatagatgtttgttgctttgataagactggtactttgactgccgaagacttagtctttgagggtctggctggtttgcacgatggatcagatattcgtacattgaagtcagctaatgatgcctctcaagaagttctatctgctatcggtgctgctcacgcattggtaaagttggatgatggtgaaattgtaggtgacccaatggaaaaagctactttgaaggcatcctcttggactgttgatttcaaagatgtcgtcaagagagctggtgcagataacattcgtatcttgcgtcgtttccaattttcttcttcattaaaacgttctgcatctattgcttctcaaagtaatcgctttttcgcagccgttaagggtgctccagaaaccatccgtgagagattgaactctgttcctagtgactatgatgacatctacaagtcgttcactcgttctgggtcgcgtgtcttggccttggcttataaagatctacctaaaatgtcaaattctcaaatcgataatattgatcgtgacgagattgaaactggcttaaccttcggtgcattcttagttttccactgtcctttgaaggatgatgccattgaaaccattaagatgttgaatgaatcttcccatcgttctatcatgattactggtgataatccattaactgcagttcacgttgctaaagaagtgggcattgttgatcgcgaaactttgatattggacgaaccaattgatggttcatctcatgccttagtcatgcgagatgtaaacgagacaattgtgaaacccttcaatcctgatgctgatactttcgatgagaaggaaattttccaaaaatatgatttggctgtgactggccatgctttgaaattacttcaaggccacaaacaattaagagacgtcatcagacatacatggatttatgctcgtgtttcaccaagtcaaaaagagtttattttaattactttgaaggatatgggatatcagactttaatgtgtggtgatggtactaatgatgtcggtgctttaaagcaagctcatgttggtattgccctattaaatggtactgaggatagtttgaagaaattacaagaacagagaaagattgacaatgtcaaaactatgtacgaaaagcaatgtttgtttatggatagatggaatcaaccacatccaccggttcccattgcaattgcgcacttgtatccacctggctctaataatcctaactatttgaaagccatggagcagaaaggtgttgagatcactccagaaatgcgtaagctagctatggaagtttcttccaaaccagctgttgtgaagaagaccgaaccgtctaaaaaatctgcaactgaccttgctgatatgatttcgggaagtttaggtgaaatggaggatgaagatgccccatctttgaaactaggagatgcttcttgtgcggctccttttacctccaaattggcaaatgtcaacgctgtgaccaatattattcgtcaaggtcgttgtgccttgattaacaccattcagatgtacaagatccttgctttaaattgtttgattagtgcgtactctctttctgttatttacttggctggtgttaagtttggtgatggtcaagccactgtttctggtttattgctttctgtctgtttcctaagtatatctcgcggtaaaccccttgaaaagctatctaaggagaggcctcaaccaggtattttcaatatttacattatgggatccattcttggtcaatttgctgtccatatcttaacattggtttacatcacaactgaaatttacaaaatcgagccaagagaacctcaagtcgacttggaaaaagaatttgtaccatcattattgaatacaggtattttcatggttcaattggcccaacaagtgtctacttttgtggtcaactaccaaggtgaaccattcagagaaaatatcaagaataacaaaggtatgtactatggtattgtgggtgtctctgtcttagcactatgtggttcaacagaatttatccctgagctaaatgctgctatgaaatttgttccaatggacgatattttcaagatgaaattaacaggaaccttgttattagatttcttcggatcttgggcctttgaactattctttaaatatttcttcatgaatagcaaggccgccgatatcgcagagcgcacttaagctcttgaaattccaggatgtttttcatttaacattttagatagatatatatatatgtatatgtcctttagagtatcaacaatagagttttccatttccgataaaactatcgatcaaagtcaagttacattacatcattctacaaaagagattgtatcatcgctttatctaatttcttccatttgtaaactttcaaatctccttcaacggtgatgatttgaaaaacgtcctgtccaagtaattcatttaattttgaaaggacaataacacactcgccgcgtccgataggattgtgcgtatccgtcaaagaatcgacaactaggccagtcaagtaatcctctgtatatgggatttctggttctagagtgaagcatatgttaaagatatgtttcattttcacagcaatgaaatgttcctgcatcgactgtctatgagagagcagcgctgctgctctccgttctttatctctgattctatccaagagcgaactcgttgcaatattttccgtaccggacactgtattaccagaatctttgtttcccagatagagagggttagctgatttcgtagaccctttcaatggcgcaattttgcgtctatttgtatttttcaacggtacagagtatgtgatggaattgttacttgcctttctcttccctagtttcatgggaggaatattatccgggatttctggggactgttggaccaattgtacccattgatcagtcttctcggaaaattccaagagtcttgactttgtcaaggacaaactagtctgtaatttaaatgatatcccacattttgagttaatatctatttcatatgcattaggccagatatataatagcctttggaaatctgtcgttgtcactttttctttgatcattctggagatacccggtaacaaagaatccagttccacgtaatcgatacctggatgattgatcttgtacaagttaatcattgattctatagttgcgaatagattattcaaaaacgacacagatcgctttaagttaagtaatcgagtctccgctgggtaaaacttttcacccacctcagggaatttcttcagattgaattccaaaagacgatctgcaaaagagcctccttgaggcattgtacatgagagggtaggttgaatcgacaacgcaattgatctcgtggacaaccgcatcttagaagtctgatgcatacctgccgaaagatcagccaataacgtacctgtatgaatcaacaagcacttttctacgtctacactgtgccaggaatcattccggtaaaccttagcacatgtcgcatctggtactatagtcaatagtccaacagattcgaagtcgatccattcagtttgagagtaatcaaactgcatatcgagcaattgttcactaaattgcgaatgatgacgacaaagtatggaagagaaactcgtaggggatactgtaacgttactatcaatgccgagtgcctgcaggcataagtcactgaaatatagtgcaactttagtcatcgtcaaatttagccgtattaaatcacgtgacacactgccattaccacggctgtccccaccgtctactgacatccattgctgtaaagtatgattgcctcggttgatggtgccagtgaaattagaaccaaatgtgacagaaccggtatcatcattcggaaagcctccagtttccgcattgatcaaatctaccagctgtacaacggcatcgatactagcgaaattctgcagtagaaacgtatcatgagagaacaggatctgtttaatcagaggaagtaactccttttcatctttaactttatctagatcgataaccggaggtgtataacgatatcgttgatccataatcgagcgtccttgttctcacgagactgaccaatgctaacttttacctcaccgatgtaatgagatgcaaggtatggaagcaaatacatatataaaatgctagatagaaagagcttgaaaacactactaagaccttctaccatccacgtgatccgaaaagtgtaagtctggaatgtattacccggaccaataacataatcactgcacacgaagacatgaatttccctctcacatccggtttaatttcctgtttttcctaatttctcccggatgaagacagaaacggaaagaacaaattttgaaatctttttttttctatgcgattcttggaaatatatacgtaagctatcccatatcggcacggcggatttgagcttaataattttttttttcatcattcatgctttttaaagcttttttccatgaatcccaattttttcttgaaattttcaattttcccatatataaagaatggaaagaatttagcagacaagataatccaaactcaatggcgaatcttctaagtgcaatttctgaacctcagtagagtaaagggatatacttttatttcgttttataataaggtcttaatttcaggacggattcgacgtatattctcttcttccttttttttttcccataagctgagataaagtagaataaacaactcaaaggatgattgctgctaagagaattttgcaccgtaatgtcggtgttgctagacgtttacagtccactaaggttcaagggtctgtcattggtatcgatttgggtactaccaactcagctgttgctgtgatggaaggtaaggttccaaagattattgaaaatgctgaaggtgccagaactactccatctgttgttgctttcactaaggacggtgaacgtttggttggtattccagctaagcgtcaagctgttgttaacccagaaaacactttgtttgctaccaagagattgattggtcgtagattcgaagatgctgaagtgcaaagagatatcaagcaagttccatacaagattgtcaagcactccaacggtgatgcttggttggaagctagaggtcaaacttactctccagctcaaattggtggtttcgttttgaacaagatgaaggaaaccgctgaagcttacttgggtaagccagctaagaatgctgtcgttaccgtcccagcttacttcaacgattctcaaagacaagccaccaaggacgccggtcaaattgtcggtttgaatgtcttgcgtgttgttaacgaaccaactgccgctgccttggcctacggtttggaaaaatctgactctaaggtcgttgctgtcttcgatttgggtggtggtacctttgatatctctatcttggatatcgacaacggtgtcttcgaagtcaagtccactaacggtgacacccatttaggtggtgaagatttcgatatttacttgctaagagaaatcgttaagcaattcaagcaagaaactggtattgatttggaaaacgaccgtatggccattcaaagaatcagagaagctgctgaaaaggctaagatcgaattgtcttctactgtctccactgaaattaacttgccatttatcactgccgatgcctctggtccaaagcatatcaacattaagttctctagagctcaattcgaagccttgaccgaaccattggtcaagagaaccattgaccctgtcaagaaggctctgaaggatgctaacttggctacttccgatgtctctgacgttatcttggtcggtggtatgtccagaatgccaaaggtcgttgaaactgtcaagtcattgttcggtaaggaaccatccaaggccgtcaacccagatgaagccgtcgctatcggtgccgctattcaaggtgctgtcttggctggtgaagtcactgacgtcttgttattggatgttactccattgtccttgggtattgaaaccttgggtggtgtcttcactagattgattccaagaaacactactattccaaccaagaagtctcaaatcttctccactgctgctgctggtcaaacctccgtggaaatcagagttttccaaggtgaaagagaattggtcagagacaacaagttgatcggtaacttcactttgtctggtatcccaccagctccaaagggtgtcccacaaatcgaagtttctttcgatattgatgccgatggtatcatcaacgtctctgctagagacaaggcttccaacaaggatgcttccatcactgttgctggttcttccggtttgtccgaatctgaaatcgagcaaatggttagcgatgctgaaaagttcagagaacaagatgaaaccagaaagaaggctattgaaaccgccaacaagggtgaccaattggccaacgataccgaagcttctttgaaggaattcgaagaaaaattggacaaggctgaagctcaaaaggttaaggaccaagtcgctgctttgagagaattggtcgctagagttcaagccggtgaagaagtcgacgctgaagagttgaagaccaagactgaagaattacaaaccgcttccatgaagttgttcgaacaaatgtacaagaacgacgcttctaaccaacaaggtggtgaaccaaagcaataagtgtaattagctgagagatacgatatcattgaaacatgcccagacactactctctttagttccttccgttcgagaagaatgataaagttccatcgaaaatctaccaagatataatgatatttgttatgaccaacctcccattttaattaaagatgttaaccgaaactattgacgtggtaggacacggtttctttgatgactcttttagtattactgaagggttttacaactttttctcttcttacttttttttctttgtctcacaatttattcacctcaagcttattacttattgagtttctccatgtacatatgtaaactacaaatatgtatgaagatgacaacctgtatataaaagactaatcaaacactatacgttaatttacatctttctatcaagagacctggcttgtattctcctattcgttattttgttgatgttacccatgtccacattaattctcaagaaaatcttgtcaatattttaaaacctgaaaaatcccaatttgataaataaaggtcatatatacattaattatcacattaaggttgatagaactttccgtcgtagcaaagatacaaataaaggctcaacattgctttcctgcatatgacactatgggtgtacaagtatctcctttgactaagatcatttgccttagtggcgtactagcattaggctttcttttgattatattgagttgcgcacttttccacaactattatccattgtttgacgtgttaatattcctactcgctccattgcctaatgcattgtttggaaagagcgatgggttttcatcacatggcgaattcttgaatgaatctggcagaaacggcgaggatttcggtcattttatgaccggtttgctagtatctagtggaattttattgccaattgtgttctaccactcaaacttgattaaccacgaaagtgcactcatgactgtttcaggtggccttatcatatacctgtgcatcgttttctttacatggtttttcaatggttcgtgggatacagaggatgataatctatttggttattaaagggagatctcattgagaaacgcacacacaacattccatccatgtttcgcccatgagtaggtggaaagcaacagatacgaacagctaaaatcagtttactacttctaaatagttatttagatttatttggaacttaatgtcggatttacatcgaaccctgtaatcgtgcttgctgtgtggcttacacaagaaccatttcaacttggttttcgattgagaagatacggtaaaaaattaggtcctacccggattcgaaccggggttgttcggatcaaaaccgaaagtgataaccactacactataggaccgaaattcatgaaaatcgttcgaaattaggcccgatggagtgctgacagtgtcatacttttgagattcagacatactcatctatgggcagtttcgtttttaaatcaacatccaactcgtcaaggaaggaaattgatgcctcttactccgctataagaaagaaactatagttcgctagctggccaacggagtcgaatgcttactaaatatgcggggttgcgaatagaatcaactgtctatcaattttccggactgataacagcaaggtaactgcaacagtatacttatttataaacgtttataattatatttgatggtcgaacttttaagatattatgtcattagttttaactgcacaaagtccagtcgtacttgaaagagaagtccttatctattgaattacattcgtaacaatcgatgctttctatgactctaagttccatttctctcatcgtaactggatctcctatggaaccctttacgttagcagagagtcgtttggtgatctctaagaccctatgaatgacgttgagaacaacattggttttctcgtggaaaaggctaatatttttagattcgaacatgtaatacaactgatgtagtagcattgcactgaacatatctccaactccggtgaaataagactcaatgactgatactctatacacatatggttgtggcgagcctcgcagcgaagacaccgaatatatgtgagttggatcatcgaaaagcgaagctgagcatgacgttattacaatcacgggcacaaactggtgaatctcttggatggccgaatacaaatcagaaatgttaacgatgggcttcccatatagcaattccatctcgaattggttaggagttatgatatctacaagtccggagtgaataatatcttgatattccggtattacatcctcatccacgtacaattggccttcatcacccatgacagggtccaacaaccatagtagatttgggttgtgccttttaatttctttataaaatcgagccatacaagccaatgtgttcctatttggcatatacccagaaagcaatgcattgtaatcgtcttttaacctcataacaccttcgaacacctgcgttaactggtgtgcgtcagccttcgacccgaatactttatccatcccatatccagtatgattggaaaattgaacactattaacacagtctacgtcccacccgacacattgtaagggaaacgttgccgctttattccccacatacccgtgaaccacatgcgattgacatgctagaactctaggcatgctatatatcaaattgattcttggataattttatcttgaatcttcttcctggcacagagaaaactcaaaaactaaacaaaaactgaatcacaagattccggactgatatgaactgaatgaatggacgttcaactggttcttgaaaccagcataacctatcgttatatattgtcttaagatctagctgtatccaactttatgtgcaacttttcttaaaactgattgaatgaatcatatcatatcataacgaatttcaccgtgcaaaactcttggatattgagaaatgcaagtaaacgatacatagataaatgcgagataaactgaaaaatttcaaatgtagaaactcgttccataaactttgttacccgactacaagctgcttatctaatatttctcgtcacccggataaacttcttgttttctcatttctggaggttttagtgcccatgggtaatcagtataacaaccacgaacacaaaaaagaaaatgaacacaaacaaaaaactgtttccctgcccgcgcaatctgcaatctgtttggttttattaacgaatattcaaatccatgctcgctattttagcttatttttttttatttttttattttcatttttgagtagtaattactcccttagcacactgtaatttaccccaggtttaaagcctggcatagtggaatacagaaaggggcgattcaaaagagcgagcaactgaccgttttttcttctgatctcggctggttatttcttagtgctcattgtttcaaacaccatccaaggcccatgtgtagtgtgggttcattggtgggaatatgtacgattcccctggaactattgtaagggctgcctgtttcgaccgatacatagcctagcttttagtttttccgttttctttttttcttgcttccgtttctcctttctttcttgcggattcttccctccccacattattgaaacctaatctgaatcggcacagtatgagctagtacattgtaggccgattcagtcccaaattcgagcaagctcttccttgttgtggaaatctgggattttctttttttccttttctttatttgtcgaccttgaagtttcaccggtttcaaaagaaaaaagatgacaccgaggctatttttttttttttttttttttggatttcccgccgcttgcaggtacaacggcttctgtgggaaaacactgatcaagaagctgagtcgaggtgatgtatgtttagggatccgtattgattgcttggaaaaaaaatacatcggggcagtaataaaggaaggacactggcttgaggaatcaaatagatgacttgtccctcagttgcattacacatacttgtacggtatatatgtgtgcatgtgtggggggtgggtggaaaggcacaaagcaaggtagctttttttttttttgatttgattcctgagatgtttgtatgttctaaaccatataatttttcaagtgaaatacttctaagtttatccgaagaaacgaaaatacaaattatgcatatataaataattgtaactttttagtttcaaccctattgctgctccaatcttgcttgcaatatgctttattccctcaattgggttcataattgggaaatttgaacaagcgaaatccacactatcaattaacctcatcagacacagatatgtcattccaaagtttcatcaagactccaactgaagacaccgtcgttccacaagctcctccaacggaacagtacccacaaggtgtcaattacctcaatttgttcagtcaaaagggcaaattgaccgttattactggtggtgctggtgccattggtggcgctctatgtgagggtttcgcttcttgtggttcagatgtcattattttggacagaaccttccaaccagaactttccgtccatttgagcaagacttacgggattgaatccaagtcataccaagtagatattaccaacgctgacgacgttaaatttgtctttgaaagaatcttggaagatttcccaggtcgtgcaattaacacattcattgctaacgcaggtattgcctggactaacggttctatcttgaacgatggttccaccccagaaatgtggcgcagagtcatggacgttaacgtccaaggtacttaccactgtagcaggtacgctgctgaagtattcaagaaccaaggccacggtaatttgatcttgactgcttctatgtctagttacatcagtaacgttccaaactaccaaacctgttacaacgcttctaaagctgcagtaagacacatggccaagggtttcgccgtcgaattctctggtttgacctctccagctggtaagatcagatgtaactctgtatcaccaggttacactgatactctgctatcctccttcgttcctactgaacaacgtgctcactggtggggtctaacaccagtgggtcgtgaagctttgccacaagaattggtcggtgcttacttatacttggcttccgatgctgcttcttacaccaacggttgtgatatccaagttgacggtggttatacctgtgtttgaatcctgttgtagaaaaagcttcgtcaacacctattactgataattgtcactgccttttcccctacatcatgctcaaaatatttctgtttaacctaactacattaaaaatagagttaaaactagagtggttccttctctttcacatactatgtaataattttatatacccaattcttatatggggtgatcattagtatcatacatcgaccctttcactactattgcgaagcttccccccattgagccttaatgtctaattgtcaacactttgttacgcgtaaacggtgctaaccaaaaaaaaaaaagacgcaacttcactcaatcatcatttagtgctatctgcacagagcgatgagaattgaagagagagaataataaaaagagcaagcaagctcgagctgatcatcatcgaaatatggtaacagcgatagagaattttatcacgcagaaactcatcaatgactgtaaacctgtaacatttttagacttgtgcgatgagttttcgataaatgtgaacaaagcaaagaatgagatggtacagtactatagcactacgagacatgagtcgatccaatgcattgtagtatgtgttttgaagcacaatgtaatacaaatgattacggatcccgagaaactaccggaaaaggaagacataaaggatttcttcatctatgcgttcaacccactggaaactattgatttgacaaatagagaaagaacacacgttacgatcaagaacccctacaagctgcacaatcaaaatggcacacggccccagacaagcgatggtattggaagtgtaattaacataaccacccaagatgtgactcaaaaaatggtggccggccccaagaaaaagtctgaggcagaaccggtcgtaacgaagcaacgggcaaagacgttcccagaagttgctgttacaaaacctaagaaaccaactaagagtatgggtctaaaatctactgaacttctggccagaatgagaagagaaagagaggagaaggagaagaacagacaagaggaattggaaaggaggaagcaccagcagcaggataaaaatcacgtcgtggtaagccaagagaaacaaaaacaattggaccaactggcctcgatgtttgacgatgatgatgacgatgatttagcccaattcgataaaaattctaaaaagcgtgataagaaagaggaaagcgaagaagaggctgaagtaaaccaccctgtagcgatagaatcagtaccttcacaagaatcacaaccagtaaatctagaccgcactgtcacaaacttagaagaactacttgacacgacggtagacgaatccttaatggaactatctcaaccagaaaaggaaaaggaaaaggaaaaagaagagccagtccacgaatcgaaagaacagaccacatatatagacgaagatggatacatggttactaagagaccagctacagaaacgaagaaaccaccaaagcctgtgaaatcagcgaaaacggcagaaccgtcaaagaaaccagcaacaccagtcgagaaaaagaaggctcgctccagtcaacgtacacttgagagttttttcggtaagaaaaagggatgagtaaattaacttgtgtatttattcaaatagtttcaaatagattcggatgatacagacgatacaaacgctggcactggcactgacacctagatagaaatatacggcgactcacgtgacccaaaacaaaacattaacacgtgaataagttacccgaatacaccgtacgcaacgatgtgaacaggccaccacgtccccttctttgtgcgatttcttctatcagagaaaaggggtggttaatatcgtttcaaacgatttatcttgccctttctattgagattgaaatttaagaattttggattaacaaagattataagacagaggaaatgattaactaccacattgccagacagcttgtacggcaataaattaattggtgtttcattatactttattaaagagtgagttcacaaaagttagatcgctatagctttagactgggttttgaagattattgctcaatcacttatcgcccgttgaaaatctttcctttttattttggaccgatattccaaattactctttcaattgaatattatcatcgcattttaagagtccaaacgttttaaagttacttctgaaactggttttttaattatcctttaagaaagttttcagacctcaacgcactatagatcgtacattacagatattttagtgctttatccaatttcaaatttgttcaaaaaagagacttcattatgagtgatttgtgtccagtgtatgctccattctttggtgccatcggttgtgctgcagccattattttcacctctttcggtgctgcttacggtactgccaagtcaggtgtcggtatttgtgcgacatgtgtcttgagaccagatctattgttcaagaatattgttccggttattatggctggtatcattgccatttacggtttagttgtttctgttttggtgtgttactctttgggccaaaagcaagctttatacactgggttcatccaattaggtgctggtttgtctgttgggttaagtggtctagctgctggtttcgccattggtattgttggtgatgcaggtgttagaggtactgctcaacaaccaagattattcgttggtatgattttgatcttgattttcgctgaagttttgggtttgtacggtttgattgttgccctattgttgaactctagagctactcaagatgtcgtttgttaattttaaggatctccaagaaaaacatgaggaaatcataatatagtgcactgaaataaagattttaatatgaatgcactcattgactctgtggtaagatcgataatgggaatccaatatatcgtttgttcgttttcagattcgtttgactctttcgtaccgttccttcatttttcatttactcatcctttttttattttattagatcaacttcgaatgtcatgcccgttagtttcttatgggaatacaatctctgcaatctttcatagaatctctatttagagtagaacataaaaagcacttatctaatctagtgcagtctgtttataatattaaacacagtcaaaaatctaaagaaaaaaattatacagtttaaagtttacaaggttgagattaattatcgctgtattttcatccaaggaattccaccctaggatgttacgttatattgaaatctatgttaattatgctacatgaaagattgacatattttataatttaaagtcttccttacatcttgaatgaacgagtcaacagattcaggtaagttgctgcatgtcgagttgtcgtcattccttaattgtgaatatagtgcaacacaagaatcgtttagcttgattttttccaaagtcttcagtattgtaaaaatctgtgattcatctaaagctgtctctgttgtctttaaaaacattgggtagaagaatttggccagcaataaaatacaatattgctctggcatgtatgggaaactaatcaattgaatcatatggttcatcgctttctccgtttcattattttcggcaagtttgtggaattcatacaaaacagcatatggagatagagtctgtctcattacgtcagttaccatactgtttagcaaatctttcggaatattgaaagagtctgtatccccattgacaatagaatttatagtaatatcatccaatggccccccttgtaggatactggcttcaaagatcatccatgaataatgtttgacccactcatattctccagctttactaaaattgctcattgcttccacaatattattctggtatagtgtatcctgtcccaagatcttataaatagtcttagccacatccggcaacctccacttagcgcataccgaaagaagccattcaatatcatcatttgtagtatatggaaagtgtggtaatagttctgctaagattgctcttttagaagagtcacctgaatctgaagataaagaaattaatcccactgaaactggccacagcgttttatcatcatacgagcataaagaaagagcaacttggcgaattaaaaattctccaatggttggttcattttcaaatgcaagttctgagttcaatccacttttatgagcaaaaatttcgtagaagtcagtttttataattcctttagcttcgcacaataccgctacaaaagcagcagttgcaaggtctaaggattcaagaatcggtaacacatcagcaactttgtcattgataatgtgataacacggcgtttcccagttattgcaaacatcgatggcattatgtttagtagctaattgtccatattcttgactcaattccaaagttggtatatagtacaacatcaatccacagtacgattcgtaccaatactgtgagaattcacagattttatttttagaaccacttaaaatcatgaagatgttcatcaaattcttcttgatttcaggttcaacctcttgttcatcccaatttgtcattaattggagtacgctattcttccattcacggaataaattttcagaatgaagtgggtaactctcaatgattgtaatcaaatcagtgacaaatactcccactgtttcatttccatgttccagcagttgagaattttgaatgcattggatactctgagaccataagcctctcaaaagaagctgtgccgttaggtcccaaaaatcagattgttcatagacttttcttcgcgtcagaagggtttcatcaaagatcttttgaataaccagctcacttggttcaccatctgatctgttcacccaattgatcaaagactctagaaggtcctcttgtttgtattccggagagtcagttaaaaagtaaattgtcttcaagcaatttagtatgctcaaacattcctcaagatctccaattcgttgcagcttattcgtgtatttgatggattcaatgtagaactctagttctgtaaccaaggcatgaaatgctaaattaactatcgagaagtgttcgagtcttgaagtttgttttattagccctatggtcggtacatcgttcttgcgatgttctcctaatccctgatacaactcaaaaagttttgatacatattgggcaaattctttagattcatctaaatgtagaaatcttacaggatatagtttattatctttcgtagagttatcaaaagcaaggcttcgggacgaaacgttgttgtatttgaagcgtaattctttggccgagggttgctcaatagggaagttcaccattggtgcattgctgacagggtcaacattgattgttagattaatatcatcatcactttcattgctgataccttcttcgtccaaaaagtctaggttatcgacatccattaataggtcctgtgtgtcggcgaattcatcgttagccattgttactgctatgattctttggtgaaaacacgcgattaaaccgcaaatttcagtttaactcaaggtttcaaaaaagaaaattatattaacagtcagtacaaatcccaatccagcgattgaacgtaactcctttaatgatttggagcgtaattggtctctatattctcattttctctcaatgtttactgattgcaatattcaaaatatatcctaaaagtgatatatacgaatctcttagaaaaatttgatgcttgttacacccgtacaccacatatgaaattccatctatccttcttgaacttccaacatttatctactgaaccagcgagtatagctatgggttgcccctctaaatgataaatttatatgccggtagatcagcatgtgccaaaaagcgcatcagagatctccaagtgctccttaaatcatctttctttatactttttcttccgtaatgaactgcgtataatttcttattgtcaaattttactgaacatcaattttcaaacattaaaagtagcgatgagatgagatgagatgagatgaggtaaaacgagatcacctagcagattacatatcgatatagcagctctgaacgacgttcgtaagggtgagaaaatcaaaatgtcctttcccaatactgcagaaggtatcactcggtatctcagatcgaagaacgtcactacacaagagatttatgacatttcggtttccgtactagatgggaaatacgatatatactttccaaatggccatatctttatattagaattgatcattgacagatggaatgatgctaaacaggcacagttcagaaaggacaccaacatttggaagttatggaaacagctatgggttatggtttcgtctgagaatcataagaaaaaattattgaggaatctaagatcagtaaatttaattcaactaacatttgaagagatgcaggacggtgaccatgagctttgtgagcatgtatatgaggtactgaaatctgttaattcttgtatgattaccgcagtctctccggaagcaggtcttaagcttttaggtagagtcatagatatcgtactttcctgtgactttggtcgtgagaacttcctgaagcaagcaataatttcagaaattttgacatttactgatttgaacaactttacggaagtatctaataaagtttctggtgtgtactgctctgaactgttgctaccgagtttgaaatacttcaagcaggctgacgaagaggtgtttgacaacatctttgacgtattatctgagtttacaaaaaggtatttatttgaattcacaagggatttgcctgcagcgttgaaaacttttgtaggtttgcataaaagttccctctccccagatttattggttttgcttttcacaaagtgcattacaacaggtaaatgcgatgccgctactctggaaaccattttaaaaatgttgttagatattgatgtcacaatatgcgcagatttgttggctacactcaatgcctacagaaagattatttcacagacgtttttagagtcattattcacttccgtatttgagtccagagattggaaaataattaagagcattatcgaaatggacattgaaattggtatcttgaagacggaagaattaatgaatgctatggacgcttcgaccactaattttgagctagaaatttggacttcaattatcaattgtcatgtcaatgccagagaatttacaaatcttttgactatctggagagaatattgtaggaaaaacaccacttcattattcttgactgattcgaaaatgactaaggtcctttccgataatgttcctgcattatctgtaacacagactcgtgcaatcattacagatttagtagatgttattgcttctgagaatgatattttttcagtgaatattttacaagttatagtttctggattgaaaatgctctcttatgcgcagtgcttggaatttcggatttatctttcaaaactttttgaaatagagggttttaatgctccagtattttggcaactcaaatatcacgttcttgaactatatgatgatcttcctatcgctgtgaagttcaatcctgacgacgcatcaggtctcatcaatcttggaaaaaaataccatagtagtgaactatttttcgccttattcaagttctacgagctccagccatttgaaaatttacctgttattgaagcttttatgaattttattggtaatctggactcagcagagttatcaaatattctacagacccttttaacgcgttggtcaactctcgtcgattcatcattcggaaataagaacatatcacacctgatcgaaaaactacttcaaaatcacatcgatattttgcctgtgctattcgctgaagaggatttttttgaagagtctaacattgttcgttcgatagtggttcacttgacagccgatgttaattctaaccttcatctgaagtatttattggaaattccaattcaatgtttgaataaggctgtaagattggcaatcctagaccaaataatagagaaggatgttttgaaagaggatgacataaatgttctttgtcatgttttgaaaaaccctacctcgaggagcaaaatagaaaccgattataaaacaatgctcacgtttgtcggcaattcattcttcaaatatagcttggaaaatccggttattgcagccgtttggcagagtgcactgcttcaaagaaacgacaacaaagcatcttcatccatggattctctattacaaagcattcaggcaaatttgaatcatacctttgattataacacttatgccttgttgcatctggtactcaaaacatgcgatgaatcagggttgcatttagatgctcttaaggttaagttcatcaatagtttgatttacaatattcagcatttcaacggagatttcaaattacttgcatggctgctcaaggttttgttcattcaagcaagtaactctaaaacaacaattcctgttccaccgttattttcgaaggcatccgccattccttctgacattgaagttcaatcggcatattttatggtatcaacactaaattacaatgataatattgaatatcttctagcgcagtatcttatcttaagagaaaatggagtgtctaaagagatgttattacaggcaataaaattgaacatatccaagagaattattaataacgatgaagacttcaatacagcattcgaaacgatctgcaatactatgcctgtactatcaacaagcaactccggagcagtattggagctgctacagttattcatccactttgtttcaaaacagaatagtagtggaaggcatatttttgtcaaatcaatttcacaccttttaacaaactactctactagcattatagacagaaaagatattatatctttcattacctttctgaatgatctgctggtggccaaaccgtttttattcacacagtactgttcagaaatgcttttcccactaacatccaagattcttttggataacataatcaaagcagctgatacacccgatcagagagagatcaaaaataagattccatactctaaaaatgacctgattttttcctgcacacatatgctctcttcattgctattatttcatcgttataagttatccaatcgtactcatttgatcaacattgttatctgccaattactggagttactatcagatgctaagcaatacgctctatcggttgaatcagcgaaagcagtatcaagattcatatgtaactattgtgagcctgcaaatgtgagaagcagtaagcagacgacattgtcctcggctgtttctaatgttaaaagatcgctaagaaagaatctgccagttgttcttctacaattcatcaaattatcagtttcaaaaccatatcccaccacgataaagaaagagttgatgctcgcagtatacgctatttttgatcttctgtcgcagactgaaatgaacttgcttaatgctagcttggacagtaacggcagatcatatttcaagacattacatgcggactacaagaaaagtggcaaatggcatgatgattgaaaagtggcaaatggcatgatgattgaaaagtcctaatcattttataaagttatgttcttctacatttatctatataccattcaattagtcgtattgccttcctatcaattctatcatcaaacgcatatagaggaccaaagtattctttatgtttaattctcatgaaatgcaagacatctttcttagtgactaatccggccatggttccgccattctctactataatagttgagcagcccaatttctggaacatcatgaaaagtatactcaacggagtagacggactaacagtaatcggggtataattgatttttgatgttaacgattcatctccacattttctgaaatcaatgatatcgtcgggagatccagtagtggcatctaagaaatagcgagcgtactttgttaatataaagccagagcatgtcgaatcacctttggaacagctgctggtgatcggaagaccgctaaattcggctgctggtccatctatcaaattttgcagatcttgacgagtcattttttcattcacgtagactagttctttcgtcatgatgtcatctgcataaaagtcatccatgaattcgtgatcccctttctgctcttccatcaatgggaatccattaactataatcatttggtcagcaattcctccctcggcaccaaaggaggaacagataattctagtgaaagcaacaactaccatggtaggaagaatatacgtaaatgcacccgtgacctcaaacatgatcaccaccactgttagagttagatttgttataccacttaatgctgcagttgcaccaaggaaagcataagttcccggtgtaatgacatttggtccagtaatataacgctctactattaaacttacagcccttccaaaagttgcaccaacagccattgagggaacaaaaattccggcaggtactctacagccgtacgaagcaacgattagcagggctcgcactacagttgcaaagagtaacgaaagcaataaattgatgaacgagatgaatgaggcctcgttgtcaattgtacaaagtctatgcgaccataatgatcctttctcattagtttgacactcatgaaataaaatttccatagattctgtcatgtcaagtttcaagaactcgttgaaataagagataatggcagtaacaaacgttagtatgacaacttcctgtaacggccatcttgagagatatttctttctaaaagaaacgtaatgcacattccatctgcttatgtatttgccatataaaccaccaaaaattccaagaaggatgaatattgggatttcttccacatgccattctctatcataggtgacttcaaaaacaacgatcttaccatttctagatggatcaatatattgtagagcagaaatacctgccagagcaatataatacgacttccacaaggcagataacttgaaaggaatagaagctgacatctcttcaagtgcaaataagacacctccaataggtgcaccaaaagctactgcaacaccacctgccgtcgaagctgtcaagtattcggattgttctgggaaggccatctccttgctcaagagccaattagtaattacataaccacaacaggtagcatagtgaacagatggtccctctttaccaacacttaaatcagaagaaatggcaagcggtaaagcgacagattttactataagggtcttcaaattcaaaaactccggggtatattggaaacctgatacccaggatttaatttctgaaataccagatccagtggcaaacggtgcaatgtgtaggaccatcagacaactaatagttgcaaatgtgaccgataagaacatgaatagcaaaaatgaaaagattggattggttgcttctacccaaatacctttttcgatacattcgctttgggatcttttaaagaatatttctgcggcattgccagccgaacttattatggaaccataactccttttactgatctcttctttaggacagcagaatgccttgtttaacaaccaatttctagcacaatgtccagatttccagtttactaacaattcagtgaatatttgtaaaaaaccagcaataccgccaatggaaagcccaatggcagtcaaagtaatgaaactgctacctcttttccatattaacctgcggtactcataccaactcgaacgcggtatatcaaattcgtcatgcgatgttcccttggacaattcacgcttctcttcctcaatccaatccacagaagtgaacttatcgaaattaccgacttctggtatatttcgcagagcctgctcctcatttacctcttggtcagtcatagctagctattgctcatcaattgggtcatacctaagtcaagggcaatactatgagtttattcataaatgagttgataaatttacatattgtaatacgtacatttttcaatacaaagaaatatgcacctttgaaattaggtaaagaactgagagtgaaagcagctcttcctggggaagtatgaagcatacgatggggaacaacaactacagactgcgtgttttagaccataatagagtactatagcaatggcggagaatggccaaatgatcacaataggaggaatgtatatcgttcttctgaattaatatagtgaaacagccgtacattacaccagtttgtgatcccatttgtttctttttgctcatcagtcgaggaattcgaaaattttcaaaaattgaaaaactaaagaaaatgatttcaagagactaacctcatctcatctcgttccatctcatctcactttatgataaaactttttttagacttggacttgatccgatcttatttctagtcttaaaacaccagattcaagcgagcttttcattcttgcaaggaacttgaactgacccaatcggatacttcacttcatattataaagaaataatgtctgctccaaacccaaaggctttcccattggctgatgccaccttgtcccaacaaatcttggatgttgttcaacaagcttccaacatgagacaattgaagaagggtgctaacgaagctaccaagactttgaaccgtggtatttccgaattcattatcatggctgctgactgtgaacctattgaaatcttgttgcacttgccattgttgtgtgaagataagaacgttccatacgtctttgttccatccagaactgctttgggtagagcttgtggtgtttccagaccagttattgctgcttctattaccactaacgatgcttctgctatcaaaagccaaatctatgccgttaaggacaagattgaaactttgttgatttaagaaggatttgcacatttcgtgatttccttttcttattctttatatcaatcgtttaaggagttaaccgctttgtggggggtttgcatagcaaagaaaagatttactgcacgttcattgattcaagtgatcgacaggtagattttttttttacgacctctgtatattaaacatatatattacaattaatacaactttttgatacatttgcatccttcttaacaatgacatcaacatctgatggttctagttagtggtcagtacatagtttttttttgtctgttcaaattaagaaatggttacaggcctgtgtattccagatgatattgtcagttggtaaaaaaaagtaataaatttgacacaatcttttgtgctttcgactatccaaccctaaatttacaagtttgttgaaatgaacttagaggaagaagtctgactgtccatcagtagctgctcgaatatgttcaagtttaacccattacacattgttggtagggaaaagataaaaatccgctatcaaagttcggataggttggattgtgaagacccgccaaaatttagggaaactcgatgtagatgttgcggaaccttgttacgacatcctatagacgcagttaagttcaaatgtacaatatgtgaggtgactgttgttttgagacaaacagcaaattctagggatactgagggcaagatactgccggaccttgaacagttatccaatatagttggtcaatgtctcgaatcgtataagaaagatcagacaggagatgagacccccgctaaagagcttaacagctacttcattcctgtggaaaaatacattgttcaaaaattcggtacagcggaagctttgaatcaattattcaaaccaactgttaaagatcaaattataaactacgaaaaagcagtgacattttataatttgataggctcattgcctaccaaaagacccatttatctcattttacgtgtctttaatgaggttttgaaaaggccaaagatcctaatggataaatgggagcactatttattcatttttttcatcttggaggtaccttctttaaggcaatgtattaacaacagtactacaatttctagaacacccaagattaagactttaagttacgaaatattaaaaagatgtattggttacttggggtcaatgaatagtaaagtttcggtgaaatataagaatcacttagttcgtttacatccattgaaatttcaaaagcaatgggaaattttaaacttgtatttgagttatcagttccagaaaataggacccggtccgccgcattcaccacgaggattatcaggaacgttgttaactgaatcatcgcctgtggatgaaaccaaagatggaactgtatcttatcttttccaccccggaaggcaaaagataccgttagagagcaggttcagaattgaaaaatacggacttgactggcatattcgcacggtgtgtcagctaatgaacatatactttcaagctcattgtgaacagccaaaatgtgacatctcggttttttacaatatgataattgatttcattgattacaaacgtgattttatgatgtggcataagatgaatagagagcaatggaggacccttgacgatttatccatgacacagttacatgaaacgcactatactgccttatgccagtacccttttttgatgtccttaggcgttaagatagccataatggagttcgaaactgggaaaatgatggaacataacgctgagcaagcgttcttaaaggcgttggactctcgtaaactttacgatgtacatttccgaataaaggtaagacgaagccatgtgacacaggattcgctaacgtccattcaacgacatccacatgatttgaaaaaatccctaagagtggagttctcgaatgagcctggaatcgatgctggcggtttaaagaaagaatggttccttttattgactagggaattgtttcatccaaaccatggactatttcaatacgtggaagaaagccgattatcttggtttgcatatgggaacaccggtcttaagcttcatggagagaacaacaatgaactatactatttgtttggagtagtgttaggtcttgcaatatataacagtactatattggacttacattttgcgagggccatgtacaagaaactatgcaatgagcggatcacttttgaagattatgaggagttgtaccctgagacagcaagaaatttaaagaaaatgttgagttattcggaactagattttagtgatatatttggattgtcgtttgagaccacgtattacgatgtagccagtggtatcaacgtcacgaaaccgttatgtgacggaggagaatcaatcccagtaacctcggagaataagacagagtttgttgaaaggtgggtaaatttttatatgaatgagggggtctcatcgagttttagtgcattccaatccgggtttacaagagtcatcggggatggtttggctttcccgatgttcaaaagttgtgaagtagaaaggctcatctgtggcagcatagaacaagacatggatttcgaacaacttcgcgctgtgacgaaataccaaggcggattccataaccaaaccccggtagtggaatggctatgggaaatactaccacaattatcccatgaacagcaacgtcaatttctccatttcgtgactgggagtgacagagttccagtgacgggacttgcgacgcttccgttcaaggtaacccgcacaacgtccggatcacatgatcagttgcccactgcccatacctgtttcaacgaactctgcttgtacgaatatgagtcacgtgatactcttcttctgcgattggtgactgccctcgaaatgtatgagggttatgggtttaaataatgtcagcaacaaacatacattaatataatcactacaaacgaaccaatcatatcgtgaaccaggctttacagaaaaacctgcttcccttgaataaccagaaaacacaaggaaatggacacttacagctactatgtgaaagccgttaaatgcgaagcgttttactgacactaggcccaaaggccctagtgtcagttatcatttccaccaagaaaatcttcctatacttgaccatttacgcaaataaaattgtatacttgtaaattggaaaataataaccacaccaggaagttctgcctcgtcccagctcatttacactgtccattcctgtctggtcgaattatatcttgtttaatcctttagcgcttcttactattggcttttttcccaatctgaaatttttctttgttttttttttttttgcttccttccgcacttattaagctgcaatggcttctgtttaatatggatagagataatttgataatttctctgaataaaataaaatagaaaaagatttagtacaatcattttattattactttcagttccaacaacatttttgcattgatatatatattttataatctggcttggtgattcatatctgtgtatatatttattgatactccgagagtgctttgctgttgtgattaaagtcgatatcatagaaacgatttctccgaaataagaacgggaaattagtacgaataatacactctagcgatatatccataactaactaatatcaaaaatgttgggtttaagaaacggtttgaagactggtttgaagtctgttgctccagccagattaatttctacttctgcagttgctgccaagtctacttacagaactccagatttcggagactatatcaaggagaataacgatgctgacaaaggtcgttcttatgcttactttatggttggttctttaggtttgttgtcctctgccggtgccaaatccaccgttgaaactttcatcgcttctatgtctgcatctgcagatgttttggctatggctaaggtcgaagtcaacttggctgctattccagaaggtaaaaatgtcgttgtgaaatggcaaggtaagccagttttcatcagacacagaaccgaccatgagattcaagaagctaacagtgttgatatgtcagctttgaaggatcctcaaactgattctgacagagttcaaaagccagaatggttagtcatgttgggtatctgtactcatttgggttgtgttcctatcggtgaatctggtgatttcggtggttggttctgtccatgtcacggttcccattacgatatctccggtagaatcagaaagggtccagctccattgaacttggaaatccctcaatatgaattcgatggtgaaaacttgattgtcggttaagcgcagaaggaaagctaaaaaaagattatattatgttgataaattgttgaaataggctacctttttttgctatttctcaaatttaactctcttcctttttctctttctctttgtccttctcactccagctttcactaataaaattctttattcccatgttgatgtctcctactccccccatgtattttccaagtaggattcacaaccaaggtcaatatcttttatgctaaagtttgtcatattggaatcgtgtaagctcgttttttcacgttccatcatcactacccgatttattattatttattcatacaaacatttttgaaaccacaactacccgtgcccccatagctcaagcaaactaaaaggatagcaagcatgaaatgcttttgaagcattgttcaattgtatgtcatcacttttccttttaactgcactgagaaacaatcgcattaatacctgaatgaccacatcaggctactaccgtgattgaaacccttttattatattccaaaatctttgaaatagtcctgctctacccgatgcatggttatacctacaatctgaatcgcttaatgttgtatcgccttcttttccataaaaggtcagacacgtatttaaagaaaagcgggagtattggattaatctgtcaatagtaactttaacctttgatttccctttttcaacgagatttaggcctaggaacaatgcattggtattgcaatgggatgtcattatttcgcttttaatttgcctattttcccgctaatcacgagaaaaataaattcaattaatcaatcctatactcttaagatgtctcaaaaactgttaacccaaaccataaaaacctaaaaaaatctcttccaaccaaaatattttaccataagaatagagaaattgacgaacaattaatttaaattgagattacctttctctctagggattcaaattttttatcatattaaggtttgtttcctgttatttatatactctgttaacgatgccaagattatatattatatgtatatgtatattccccacatactcttttaaaagaaatgaacaaatttaatccatttgaacgccgaaaattgggaacccttgaaaaatccagtgctgtttgtagactaaagttctgggttagcttctaacaagctttcaagatcatctggaattcgctgccaattttctcgatcccattcggttagcatatcacacatctcttttcttattttgttgatatcccttttctgacaattgcacccgtcattgacactatcaggaggcagcaatggttctgaatcaagtccagggtatgatatcaaagatgaagtcaacgaagatctgaccataactttcttcttcgtttcaccgttcttcctctttggaagggatatcttttcatgctgctcaattaaatctacgcaataatctggcaaattcttcggtttgtaatcgttgacaagctttatcctccagtaaactgaccaatgaagttcgccatattcaggtatattccgtcttctaccaaaatttggcacgtaaacgtttttccattcacacttttcgttttcgattcttattcctattggaatcaattcagcaatccaccaaaaaatcaccctaaagatactcacatttccacttccatcattttttttttgacgaccgatgtccttccctggttcatcagtatcaaaaccttgctcaagatcagaacaactagatggtgattccgttttccagttaaacgttctgaagtaaacgttctctgttttatgacgccacggtaaccaacttctctttgatggcagtttgaagccgtggtatctattaatttgatcttcatcatattcattagtctcttttttgtgaaatgggtttttcatagtaagattgctctttttgaaactcaaaagatcgtgcgatgctgacaataagcttccagcagatgtatatttgccagcaaattcatggatgattccttttttaaaaagtactccggatttgatcgcttctgagagaatccatcttagagacatatcacttaaaaaatgatttttctcagtgatatccggtggccaactcccaccaatatctgagtgatcgcctggaaaccacttctctattagatccgatgatgtccttttactatcaaaagtaccatggggagagtccacctcgaatataccttcaactctctggttcacgaaattatctgttctttgggaatgttccagctctaggaaattgttgattcgggatattagttcttgtacggacttactagattgtgattgtgatgaattaggtcttgagccaatggtatgatttataaattggttactggtactgtgatagtttgttttcggggcaacattctcatattctatgacataatttctatagttcaacgaaaataaatttggtctataaggattaggggaaaacgactgttgtttgaacttccctcttctttcgtcaatgctaaccgcatgtctgatgtgacgaacgatgccgctcctagctgtatagggaaagagccgatctaaaagtataccacaagaattcaccgaatcaaagaggccttgaaaatgtatttcgatctcaatatttcttgaaaacgttttcttaaattcatccaccaaagtagtcgcataactcggttgtacgggctgtgcagcgtattcccaggcttcatatattttccaagccatccatatcatttcatctagtccaacgtttagaagtccaaccatttccagcattccagctagtacccttgctatgaacgcacctctgctgaacccgaacataaatattttgtctccgggttcgtagtggtgcattaaatacaggtaagcagtcataatatgatgatccaaactgtaggcaacagcagaatcaatagccgtcttcaatttcttccaagtaaccaaaccaccaaaaccagcttgtgcatcatactccaacgaactaccgatgcctggttggtaataacaaatctgcctttcataatcagagccatcaagcatccgataaagcttcaatacattgctgaaggggttggggccgaaagtattatccgttccatcaaaacaaagtattatatttttactggtggtactctgaccagtgcccaaagaggatgatgccattgaatttctaagaaaagcatagaagagctatgctattttttttggcacttttttcggcttgatgtctcgaaatactaggtttatatacagaagctgctcgagctggtgtatcgagcgccacatattacatccaatgctgtatgatcttttgtgtcagtggcatcaaaaagaaaaaaaatatctttcgttacccgcatttgtgacagaaatttcactcaatctgaatgaggaagccagcatagatagaagagaattcaagggtgctacaaaggtaaatgtttaatcggtatctctattagctgatttaagtacccaaactttctttaacttatcaaatactgcgacatcttttaagattttccgaacacgttctacgtcggttgagtttgttagctgtaatccgactctaatcactagatctgctgatttgctcgcaaaccctggtgactgagatagatatttttcaatggacgctttgagtacctcggcgctcttctcgtccttctgtgtagcatctgattgaatgtcctctcttttaattttctcccgctctaacgtatcccggttcaattttcttgcaaacttgctgtcatttgtagataatgcagtcctactctttcttattttacctgccctaccgaatttaccagtccaagtcggagtgccaacatcaaaccttttagtttgtttccgtgagttttttaatgcatcaagtgcagatttgacgttacgagtagcttctgccccaatgatatcatctctctcgttagtatcaacgctatttgctgaagaaaataagctacccatgattctgtcgtcttcggtgctctgcttctcatcttgttctttagagttgaaaaatccctccaatttgtgaacacccgaaatctgcgaaagtttatcaaaatcgtccgtctccgaagtcttgttctgctttatattacccgtttgtttaacaatttcttgattgaattcttctgtttcatatccattatctcctcctagagtgaatagatcgtgtaaatcattcattttgaaaaaacgcttttgtttgggatctttcaagattttatttgataaaaactgcttaaagatctgtctgtgataaatcttctcctcaatactgcctgcaatcattaatctataaatagtgacctccctcttttgaccgatcctccacgcacgttctctggcttgcatatcagtagatggattccagtccggatcaaaaattataatcctatttgcccctgttaaattaataccgagtccgcctactcttgttgtaagtaagaatacgtcataaggttcgttgttgaatttatccaccaatgattgacgagatccgatgttagtcgtaccatccatccttaaaaatttaagatctgatagttcagggtctttgtaactgatgaattcttgtagaatatccaacatttgtcgggattgagtgaatagaagagttttgtgaccctgtgaatgccatagtagtaacaactgctttactacttgcattttgcctgatcttgctggattgccgtaatccgcgtcttcataatcgttcattttctttcgttttaaatccaataagtccgggtggttacagatttttcttaatatatcaataccatatagaacctgccttttccctttccttattttcatgagctcgtcagagtggaggaattctaagtacttcgatttttggtactgtgttagcttgcagaaaagaaccatttcatttttctttggtaagtccttagcaacatcactctttactcttcttaataaataaggggaaatcaaatctctgagagcaacagcgcacttataaccagttttcacttgtatatttgaagcgttggcatagccacccatgttgataggattagcaaactgttgttggaatacaggaagagtcccaagttttcctggatagacgaaatcgaaaagggaccataattctgtcaagttgttctgaattggtgtccctgaaagaataattctgttctgtgtctttagctgcttgcatgtcaaagagatatctgaatcaggattacgaatcttatgtccttcatccaaaatagcataaccccaccttacattcagtagcgcttcagaatgtaatcttaaaccaacatacgtcgttataataatgtgaccatccgtgatcactttttctaaaagctttttgacactttttctcgattcaagtgaagtccgcgttttctcttttttctcatagtcattatatgtaaacgttccgtaatttgaagtcatcaacatcttctctagttcctcttctggaatctgtgtacctttattcataccggcaccaattgaatgtagaattacagctctaaaaggtggccaccaagtatggaattcgttacaccattgtttcatcacagttgcgggacaaacgacaagtacagggccattcaattttcgggagtggtgcaaagtggcaagaaatgcaataatttgaatcgttttacctagtcccatctcatctcctattatgccaccgcatccttgttgataaagctcacatagccattgcacacatgttttttgatagggaaatagcaaagggaatatatcaccaggtaccatgaaatcttcactgatattggcgtctgaaatttttggatgtggtttcaaccattctggaatatccggttggttatcgtaatcgcgatctttacttctattggctacccacttctttaatctttgttgataatgatgctcgtcaccgtcatcaatagcctctgcaggtttacgaattacatcgagtttcccagctgattcgtttaaaagttcttctgaatcacttataaaatcagcctcgtcttcactttgatcttcttcctcgtcaatgttctttaacatttgtcgttcagctagtaagattgatttagattcttcttcgtcttctaccttaaaattcacactatttccgaaccctgtgattttaccggtcctcaacaagaaatctctttccgactcaccaggttgtctctctgtagattttgtagtcgtatcggcctcattagtctctttcaaacctttaattctttctttgatttcagcaatatcctgctctaagggttttaattcataattctcgacatcttcaatctgctctttcaacttagcacgaacactaatcctactggcgttgtaacgtttacttaacaagctgtcccgtttctgtcgaaggatatcccgcttgtttgtgtacctctctagaagcttttcttcttgctccaatgtctgtttactaatcatattattagcattattctctatttcttgttctaatgatgtctgagacatcatttgaaccttcaacccacctaaattgtcaccgctcattgttgatggttgttggttttcaaatgcgtacccaaatatcttctggcactctttactgttgtatggtttttgtatatgttttactcatcgcaggaatggtgcattattaaatcatatctcaggatttaatgattcaatttttcaggtaaaacgttagtggaagtctcaacgctcgagacgataaaacaagaagtaaaaaaaactagagtcaatgggctcggtgatattaatcccgaaatggcctttcagggcgtgccttcaacccatcatcttatataatttttccctattccctcttatataatgatcaagcgcggcaaatttaaaaaaattcggggcgagctgggaattgaacccagggcctctcgcatgctttgcagtagttaaacctcgtttaacgaggtttggctaagctattaacccaaagcgagaatcataccactagaccacacgccctaataattgttgaggacttagtttcagaaataatcgacctacctctaggagcttgtaaggtgtttatattttgatataaccttcccagaactaggagcctattcacgaaaatagcacttgcatattatcatgtcactctattccatactgcaatatatctcaacttaacaaccctcgggttaacctgagacaatttccgggttttcttgcaggcgagtatgaaatgaaaatatggctattagttaaatatatgcataccgatacgtatattaatcgagtgttttcctaatgtcaatcttcttgtgtggtaaatttatgacatctgtgcatagcttcgtacaacctactagatagccattccttaaaagatatattaaccgaaagggtatagtcaagtttggtattcttggaacaagacgatttcaatgaggcaatgcgttaacaaaagggtttagaatttggattgtagaagagcagcacacggcagagtattatttacaagatatggtgtgagttatccagttttatgcaggagcgacaatttgatgatgaaatgttttgaagtaaaaaaagagaattgaaagaacagaaacacgcatagcaaaagggattgtatgccttaattcttgctggcactatctagtaacttcaacttctcatactcttccttggcgttgaagtctccggtagatagcttttcatattgctcatcgtactttcccgtagataacgcaccgttgcctctgaatcttttggtcatgtcaacaataccacgcttacaatccaaaaatgctttcatctgtgccatacagagttctggtagatctttactcaacttaggatcttctatgcactgcttaggagtgtttctttcgatgagcacgcatggcgatctctgcaaacagatagcaacagctttcctttgatcgttacaactggcacccatttttttggtatatgcttatgattagctttttctattattagtattcttaccagcccttgaataaattcctctagtagctcctatatagcatgaacttctttggattaaagaccgatgacctgtattttgtcacaatgatcacatcttttattaaaggttctttcttagtctccaggaaatacagaaatcgttaacaatgacgatagaaagcactatacttggaaatgaataatactaaggttaaatgttctacgcagaccgaaagggcatgttatgtaactacatagcaccaagtctctgaagctgttgccctgttagctggtatttgaaattaactgtgtgcacaattgggtgtaaatgacattgagtttcctccccggtgtgcctaatagtactcctcaagcagcttgccagcggtcatggaaccataataccatattggcatactgctctggtaacaatctaatattgctttccaatcgttctgagcggcttcaaacaatatatttgaattcagattgtcatgctgtcgatgttaatcctcgtaatggtctcattgctgttgctgtttctcaggaagtgtacatttacaaaccgctgcatcaaatcatgaagaaccctaaatgggtattctgctgtaaagtgtaccatgatgattcccgcgtcaacaccttgcaatggggtatggggaatgaattagtattgggatcagattacctatcgttttgggatgtaaaggatgtttttggcgagtacaaacctagactattatggagtaaaagacaacctttgccagtttatctttgttcaataacttctgattctaaactcatatctagtatgaattataacgatagaacagtgaaaatttggaggcgagtgtcaataacatcggattcagatttctttgatctggttattctccctcatccagatgttgtgaccacctttaggtggaaaacaaacgatcatcaatgcaataaagaacatattacgcatgtcatttacactttatgtgcagatagaaagttgagggtatggatcagttttgatattgacaataagaagaatgttcagcagtggggaactgtggagatgtcaaagtccaataacgaaagattttgtgttattttggatagctggttaatccaaaaaaccttgagaaaaaccatcaaagaccaatctcatcaaagcgaaatgatcaagtatattcttgaaaaaaaacctgaaattattctatttaccactcccagtctcaaaattagagtgttggcattgactaatctttcagatgatgtaccgaaaattatgtcggtcaaagatctattaagaacttcaatatctaatactgcaatgggatcatctccagagttcgtacatttccctgaaccacagatttttgatgatgataaaagcatatcttttgttgttcatgatcttcatggaagcgtaaggcattcattgctacacatttcatcaattttgaatggaacagaaaccattggtatactacagcataaatggaccggacacacaaaatccatccaaaaggtttttagaagtagctacggttctgctatattgacaacatcgaggttccaggaaaattctatctgggttccattgagactaaaggactcggttacgttgtcaaaaaaggcaatgctaatatctgaatcgccaataaaacatgctttagtccacgacagaggtaatctggtggtaacttttctagaaaactgcaaagtgcaactatgggtgtgctcttcaaatgagaagagagcaattcttaaaagcactttctctgcagataagacgaaggggatcccatctattatggtcaatacttctggaaacaagccacacaatgatcagcatttttttgcttatgtttatccagatggtagttcccaaggctttgtattcacgaaggatgacatgaaacagatagatagcaattctattgacttggagggagaagaagagttttatcttgtgtccgcgattgatccggtgagatatcaatttcaaagtgacagatcattgattgcctcaattaccaaactcggagtaataaggatatataaggcacaggctgatcagtcgggtataaggtggaagaagagttatgaaaccattacgaatattactaatgcttcgaaaattacgggatcgtcaaatgataagatatctgtaattgacgaaaaaggtacgactatgactctatgggatttgagaaggagtgtcttggagtacgaaactacctttgatgacgaggttgttgatattgactggacaagcactgaatttgaacaaagcattgttgccattggtttcgaaaattatgtcattctttatacgcaactaagatacgattatacgaacagaaaccctgcttacttgccaattgagaaaatcaacgtttcacagcacactacacatgccattggtgactccacctggttgaagaatggttctatcatcatagccactggcaaccaagttttcataaaggacaaaagcctagacttgaaggacaaatttacgtacagctcaattggctctagaaaaatcttatcgaatgatattttgcatttaactagtgtattgaatggtccattgccaatatatcatccacaactgttgatccagtctttatttgctaaaaaggtcaacctcgtaagagaaattctcctaaagcttttccatgcgctgcgcaagatggaattcaactctgatgagattcacgatattggatcatcactgaaattaagtccttccaagtttcttcatacaaacgattctacgtatgtgtttgataattatgaagaaccatatagcacatttgattcgactgtatcggctccacttattgatctcctttcaaagacccctttaccctatctcactcgacatcaacaggtgaccctaatttctgtgatcgaagctgttcaagagataaatttaaatgagaaggttgtagacataaatggtgttagatttatgttgggtgtaaaattgtacacatcgcataagagcacacagacaagtgtcaacatgagagatgtcagctgggccactcattccgacaataaagagattcttttttcaaatcttttcaatagattaaagaaatgggataacgtgaaagaattcaaagttccgtattgggcaggccagcaggatctcgtgaaatgtttcgagaatatagccaaatttgaattcaacaattatgataaaagagatccatcaagatgttcaatcttctatctggcacttaaaaagaaaagtattttaattggattatggcgcatcagctctggtcatccagaacaggcaaagatgttaaaatttttgaacaacgacttcgcagagcctcgttggagatcagcagccttgaaaaacgcatttgtcttactcagtaaacacagatatatggatgcagcgacgttctttttgttagcaggttcgttgaaggactctatcaacgtgctccgaaaacagctcaatgacttagatctagccatcggagtatgtagggtatatgagggtgacaatggacctatactccatgaatttttacacaaccaaatccttcctaccgcaattattgacagcgataggtggacaactagttacgtttattggaaaatgcggaaacaagatcttgcgataaaggccttagtccagcctccggttgaagtggatgacaattataaatggatagagaaagataaatgtgtcaacaagtcgtttctagtggaagatccacttctcttacaattatacttgcaattgagagaccgaaatatcgattattacaacgcagcattagaggtaaatgaaagcttagagtatgaaattattatgcgcgttgctactatatacacccgcatgggatgtgattacatagctgtttctcttttgaaggattggaagtttttggaaagtaagaagattgaatccgaacaggttgaaatccctcaaagttcccactcgaagttgacagataacaagattgaagagccggtcacaacacaaaaggtacgcccaagtctctttgataagtttgactctcaattctcggaaaatacgcgatctgtatcctcgtccacgagtgagtcaaaaagtattctcaaccctacttctagggatataaactcttcaaatggacactcaggtaaaagtgcaggctctagtttcaacattctggattcttacagaagtgacactcaaaaagtgaccccatctcaagtgccgaatatgctggacagtttcaaggaaaatcaaaaagatacgatacaaaagaaacttcccacacaacaaaagtccccattggatgattatcaggcaagtactaataaaccattcgttccgcagcaacacttacaaaattcaaagcccaaaaagacagcgaagcctagaagtttattagatgattttatataaaggtaaaaggaatgaatagcatccctaatcagttaaagaatttacctatgctttttttccttctttcgagatcgctcgcgattttcttctctgtaatatctattttctgctcgacgttcttatcctcgggaactgtctttgcgctgttcttatagtcagtgagagcggcttcaaatctattcaaagcataaagacaattgccccttcttaagtatgcctttgccttgtctttgtttcctacacggtcatcatccactaaaaaggtagagtatttgattgattcatgatactctttcaaataaaatagcatcagacagatgttcaaatatagtttatgtttctggatagtgaacttctcattatgaaacttgtctatatccacttcaggagtatatgcagtagtatatttcaaggccttcttgtatttgaaaagagcgttcctaaagtctcgtttcttgaatagcagagaaccagattctttaatggtctctgctgcttcatatgctttggcaaaatcttcgccttcgaagtgggtgtcatcatctggattttcttcataaaaatcattaccaattgtatcgttgcatgcattataaagaggtatttccatattatcagaccattcaccgcaatcttctatgattattgaatcatttggtactccattttcatcgacatccatatgctcaattgtgcgaacaacagatttacctgctatcacttttccaaactgagaatgtttaccgtttagatggggagatggataagtagtaatgaagaactgagaactgttggtattctgtgaaccagtgttggccatagccaatatgaagctttcggtaaattcacccaaattttcatctggaaagttcccaaaacattgaatttcatttctagatgaattttccaactcagattcagtcgcataaattgagcaaccgccttttccaacttcttctttgttaatcttgtcgtcagaaccgaacatcaaatctccagcttgaatcataaaattcttaatgattctatggaagtgatttcttttatagcttaacactttaccattaagattgacatctcctctgcatagatgtataaagttagcacatgttttaggggcttgttcgtcgaacagttcgcatacgattcggcctattggctcatcgccgatcttaatatcaagatatactttgtgcatttcaacaatgaattcaatcttacaggaggagcagttatcctttttgacctattaccttatctttttctattgttactttgaccacagctataaagcgcaacttagctttggaacaaggaggctttaactgatgggatgaggtattcgttctcatctcatcactgttcttaaactagctgttcattcgtaatgtcaaattcgtagatcattttgtccgggtaagaaacttttatcaaagttcaggcgatctggtattgggacctcgaaatcaaacaaaactttgggaacagtgtgataggtaagtaagagggagaaggagaaggagaagaaaggaaggacttttgatcgcgattagggttctacggttgactaagcttgaaccacttcaaaaaatgtatcgacaagaaatgactcgtgataatgtggctgttgatccggtcacaattgtcatcaaggaatgtatttctttgtcgacttctatgaggaagtacgcgaaatattcggtgcaatctggtgttgcagccttgttaggggggggaagtgatatattcataaatcaggacgcttcattggcaggtactttcaataatttagcagctagtaagactaaggatccactactgtcggggttaattcagttgagattgatgttaaatcataaagataatttagaagatgttgatgcgctaactgtcttgcaacctttcttattggtgataagcacagcttcaacgtcaggatatattacatcattggccttagactcattacaaaagtttttcgcctttggtattattaacgaatcttcgaaaaaccatgtcgcagcttatagacaaacgatcaactctttaacccactgtaaatttgaaggtactgaacatttatccgatgattctgtccttttaaaggtattggttcttattgaatcaattattgcttctccttcaggtgagattctttccgactcatgtgtgtacgatgtgttacaaactgtcatgtccttggcttgtaacaaaagaagaactgatgtgttgagaaaggcagcagaaatgagcatgctatcgattaccgtcaagatatttgacaagttgaaaaagttagactcaagcaaacaacacatcttcattaacgatcaggacttctcgaagaacgttttgaaagatgacaacataggtgccgaaggaagcagtgacattgattccgttgaaaatggcaattttacagcatcaagtgaaagtcaaaatttagaatcggactacggacttgcagttataaaagattatatggacattttagtgtctcttttgttgcctgagaaccaacacaaacaaaacaattccactaaggtgtttggtctgcatttactaaatacagccattgaattagctggcgacaaattcccacaacatccgcagttgttttccttggttgccgatcctatctgcaaaaacattctgtatatcatccaaaattcggataaactctcgttgctacaggctgccctgcagctgttcacaaatttgaccattatacttggtgaccatttatcattacaaattgaatttaccatcaacactattttttcaattttattagattcaaacgtttcagatgagactaagccaagaccagctgttgttaaagaattattgattgaacaaatctcaattttatggacaagatctccttcatttttcaccgctgttttcatcaactttgattgcagcttggaaaggtcggatttggctattgagtttttgatggcattaacaaaattatctctaccggaatctgcgctaacgacatcagatagtgttcctccaatctgcttggaaggattgatatctgttgtagatgatatgcatgatcactttttgaaagcaggagtgcaggaattcgttccggaagaactgggcactctcaataagagaaatttgaagaccgaattcattaaatgtgcagaggagtttaataaaaagccaaagaaaggcattccattgttgattgagaaaggtttcatttcgtcaaattctgaagatgaaatagctaaattcctttttgataataatgctcggttgaacaaaaaaactattggtgagtttattgcggcgcctgaaaaagtcggccttcttgcaaaatttattggaatgtttgactttacaggtttaagaattgatgaggcaatcagagcgcttcttaccaaattcagattacctggtgaatctcaacagatcgagagagttgtggaacagttctccgctaagtacgtcgaagaccaacactataatcctgaaagagatgggctggaaattgagggagattattctacaattcagccagatgcagattcagttttcgttttatcttactcggtaatcatactgaatacagatttctacaatcctcaagtgaaaaaacatatgacatttgaagattataccctcaacttgaagggttgtaacaatcagaaggacttcccattatggtatttggacaaggtttactgttctatcagggataaagaaatcgttatgcccgaagaacatcatggaagcgagagatggttcgacgacagctggaataacttaattgcagctaccacagttgtaacagaagctcacgaagtcagcaaatgtgaaagctatgtccaatcgttaggccctaatcaattgatacaatttgataaggctatttttgaaagcgtgggttcttccattatagaaactttgtttaaaattttcgaagttgcttcagacgatcatatcgcaactagaatgctcacaacgttagataaatgttcaaatcttgccagcttgtttgaacttggtgatatctataacgatgtgattacaaccatggccaaatttactactttgacaggagaaagaaaacctgttgacgacgtttatgttgacgaaatacccgtcgttcagatcgatgtggaagattctaaagaaagcattgcggtaagtaatgtagccattcttctaggcaacgatttcaaagcgcagctgtcaaccgttgttctattcagaattttaagacaaaatacaaacgtggctcttattactgaagtgacgtggaataaaattatcgatatgcttttgagtttgtatgaaaatatgttgataacaccagatattttcccagatttacaagtgagattgaaactaccaaacctacctaaatgcaaacccgaagttctcatcaatagatcgaactctagtaggggtttgctttccacatttgcttcgtatttgaagggtgatgaagaaccgacggatgaggaaattcaagcctcaaccaaggcaatggagtgtatcaaaacggcaaatatttctgcttctcttttcgggaatgacaagaatgttaatgacaccttaattaaactattgcttgaacacattaaaactgaggttaacgatgataacaaaagatttttcgagccagaattgctattcctcatggagttaagtgtctccctgttcttattttgtaagaatgatgctgttttagggaaattcctgctagacaaattatcgtcaatatgccaaaatgtttctttatccaaaaatgtcattgtgagaataatatcatacaaaattttgattatctccattttagaaaaccctgagtatgtggttaaattaataaacgagcagttactcacaaagaatgaagtctttgataactcgttcttcaaaagccaagcaggtgcaaacgttcttcagcgcttgttagacttagctgaaatactgaactatcagggtgcgcttcttcatgatcaaggattctggaagctattgagaaagtacgcggcgttaggcactccttcaaaccaagtttatgtctttttggacacatctgtgatgaaaaagaaaaacatgatcgatgatgtgaacttcatgtgggttctcgggctgttcgatgaaatgtcttctgttggagctgttggaagtcagtgggaagaacaatacaataatcttgtgaagactggtcataaagtcgataaagagaatccctatcaagaaatagttgaactatctctcaaatctatcaatttaactacacatcttcttaatacaaaacccaccgtctcgaaaagtgaaattatcgcgattattcaagcattatcacatcagtgcttgaatccttgttttcaattacgttcttatgctctaagctccctcgaaaatctacttctaaaactgttggagccatttgttgataatgtgatttcagttatagcccttattgaaatgggtttatatccgctaacaaatgaagttgacgctgattccagaaaagcggtacctttgcagaacttcttgtcgttgttatcaaaactatatctacattacttgtctttagagaagactgacaatgaaacttatttgaaagtgttgagtatttttaataagcatgtcgatgacggaaaggtagaagaacaattacaagacatgatcactaagaaacgtgaaattgagaagaagcaaggtacaccaagcacagatgctgagtcggtgcccgctgaacctaccccagtttcaaaataaacattgtgtgtcccgcactatgataaattccaaacgtccataattgaacagatgcattagaatgttaattaaactgtcttgtctactaataaatatttacagatttcatttataaatttttttcattgcagtcgtttatactcctcaggagaacgcagttgcgacctcatataatcaagcaaaagaagaccggcagtagttccaggaataattgccaaagtattcctagtaaaacctttatataaccaagcaatggtttctctcttacttctcttcatgaaaaagaacacatgctcgaatgtatccaagtatgagttgtaatagatgtgaaacctactactgcctttgggtatccttattttcgtatttggaatatttcctatagttgtactagacgttgatggtagatttttgagataaatatcgtacgcttcaagtctagagacgtggattttctgtagctttaggaacgggaattgcaccgattgaagaacaaaagctgctgtaacacctccaataaaaatgaaaactcttgaataccacatttcctctttaggagaaattaaccttggtttcttcgtttcaatcttattaccatcttcatcgaaaaatatatccgagagtcttgtgttctgcaccgtatattttagttccctataattcttgataaaatctaacatcaattggcgaattggtcctctgatcatttcaaaagtagtgaaatacaatgcaaagccaaaggattctcttatgaatgataatccaaacccaccaaagcagccaatcaaaccaatctctctgatcttatcacgactataaagccatagattatcatatttttttgcgctggataaaagttcatcaatgtttgctcttgtataaatggcatctattggagctgagacaatggcttgtgcagcacctgcaaggaatcctgctcttaaaaaatcaaacatattatgttgaaaagcttgatctgtagccctcaacggaaaattattcaaagtggctaaataagtagtgtatagcacaactcccgccagcgaattggctactaatggcggtaaaattctgtcaggtatgactttccaaccatatctgttcaatgctttagtgacgattccgattgaagagttctccaaataataagtatactttggattccaaaaccgatacctcgaacttcgtacttttgtctcggactgtgtattatcgctacctgtaagaagtactcgaatgtaatgagtatagtcaaatctagctggtctgaacaattttaacggagtcctcatgtaaaaagatgttagttgatacaccatagatcttccaccagcagtagcagcacccacaagagaagaggtttggtttgataatgaattgacatttgctttatctgaaacatcttccaatctcttgttggcatcagaagacatcactgtctcttccccttaatgatcacttgaacaaaactccgatagggtatagtcaatatgtgaaactggacactatatcaaagcaaaaagtagtgttggatgctaaatgggatcgttttatttaggttctatcgaggagaaaaagcgacaagaagagatagaccatggataaatgattatgttctaaacactcctcagaagctcatcgaactgtcatcctgcgtgaagattaaaatccaacttagaaatttcgagcttacggagacaatcatatgggagaagcaattggaagatagaaaaaaggtactcggtacataaatatatgtgattctgggtagaagatcggtctgcattggatggtggtaacgcatttttttacacacattacttgcctcgagcatcaaatggtggttattcgtggatctatatcacgtgatttgcttaagaattgtcgttcatggtgacacttttagctttgacatgattaagctcatctcaattgatgttatctaaagtcatttcaactatctaagatgtggttgtgattgggccattttgtgaaagccagtacgccagcgtcaatacactcccgtcaattagttgcaccatgtccacaaaatcatataccagtagagctgagactcatgcaagtccggttgcatcgaaacttttacgtttaatggatgaaaagaagaccaatttgtgtgcttctcttgacgttcgttcgactgatgagctattgaaacttgttgaaacgttgggtccatacatttgccttttgaaaacacacgttgatatcttggatgatttcagttatgagggtactgtcgttccattgaaagcattggcagagaaatacaagttcttgatatttgaggacagaaaattcgccgatatcggtaacacagtcaaattacaatatacatcgggcgtttaccgtatcgcagaatggtctgatatcaccaacgcccacggggttactggtgctggtattgttgctggcttgaaacaaggtgcgcaagaggtcaccaaagaaccaaggggattattgatgcttgctgaattgtcttccaagggttctctagcacacggtgaatatactaagggtaccgttgatattgcaaagagtgataaagatttcgttattgggttcattgctcagaacgatatgggaggaagagaagaagggtttgattggctaatcatgaccccaggtgtaggtttagacgacaaaggcgatgcattgggtcagcagtacagaaccgtcgacgaagttgtaagtggtggatcagatatcatcattgttggcagaggacttttcgccaagggtagagatcctaaggttgaaggtgaaagatacagaaatgctggatgggaagcgtaccaaaagagaatcagcgctccccattaattatacaggaaacttaatagaacaaatcacatatttaatctaatagccacctgcattggcacggtgcaacactacttcaacttcatcttacaaaaagatcacgtgatctgttgtattgaactgaaaattttttgtttgcttctctctctctctttcattatgtgagatttaaaaaccagaaactacatcatcgaaaaagagttttaaaccattacaaccattgcgataagccctctcaaacttcctccagactgtttgtcatccaattggtaagattaattatcatataccccggataagaaaagaagcaagcacacaatggatcaacttaatggtaaggaacaacaagagttccaaaaaatcgtggaacaaaagcaaatgaaggatttcatgcgtctatactccaacttggtcgaaagatgtttcagcgactgtgtcaacgacttcacatccgctaagcttacttctaaggaacaaaactgtataatgagatgttcagaaaagttcttgaaacacagtgaacgtgtgggtcaacgtttccaagagcaaaatgctgccatgaatcaaaccatgggtcgttaaaaggtttaaagaagaaattctccctaccaacctcaaattttattctgtacatacttcattatattataacattatattataacattatatcataacattttatcgtagctactacgattaccatagattttaaggactatctctcccatgtatattcattctgtttctgtatatagaaaggtttgcatttcattgccatatgactggccaaaaaaagatgctcctcagacacaaggtaatcggtattgtgttatctgcgtaagttgcagactccctgcattgcactcaactaggcattgtcgtaaatgacaagctaaactgtccgtccgttgtccctcccatgtcacgtggtctccattagagaagaactggcgacttgatttattataacaacgacaatagggctcaagctgaagttccattagaaacaaccttctcacgaagcgaaaatcccgttagggatttgcttgattataactcaccgggggtttgaaccctcggcgagcggacagctgcgttccaccgaatttcccacctggaatgaggagaacaactcctctgatcaagtagaacattcaaatcacatgacctcttctcaaaacacttcaaagtaacgagcatccaccttatacttaagagtgaatattctttgaagcgcttcaagggcttagtatgaagttgagaacaggaaatgaattgccatatttgatctttttgtaaccaggttcatatgaacagagactttgtgttctgaggaagattcgaaccgaagtcgcaacgtggcctttttaccagctacggcacaacacccgactcaaaccaattacgaattcattcagtagtagaccctgtcacgtgtgtgtcaggtgtcatttccgtagttcagagtatcatccacgaggccaaggacgagaatataattaaacttatgtaaattatcaactccctataactcatcatctgtgagcatcaattcatcgtcagctaatggcgtgaattgaggacctacttcaacaacggcaggtctcacaaacccgccgtaattcttttttactggtccgaaatacttcgttccttggaatgtaccattgttcttaccgtcaggttcgtcaaattcaattccacaccatacatctgtattactgatctcttgaacttttcccacgtatcgtaaccatcctcttctttcggggaccttggtggaatcggtcgttgtttcctcgttggacagtactctgcatctttctccaacgtgtttttgtaatagttctgccttatcgatattcagttgtagttgttcttccatcttagagcggtattcaggattaaatttccctaacttgttatcttttttccattgtaatacagaatcccttctgttctcataatcgtccatggtgtatcggaacgaaacgtcatcgctattagcatgtagcaaatcatttttcaattggcttgctaaactgttttcgttggtgtctatcacttttatggactggattttctctactttctggtctttgagatctttcaaatacttgctgttctgtgcattgccatttatcaccaatttcatgtcttgaacatcaacaccggtcaattcgttcaatctttggcccagatggtcccatgatgtaccaggtttcacaaagatctgagtgttaaccaaatcggatataatttccacgtcagatgacattatcggtgctgatatatcctctgttttattttgtcttcgatgctgtaagttcaatgtttgtcgttttgtccaggcatgtttgaacatcgaatttttcaatgttccgtaaacttaaatgaaaagttaatttgaaaccagtaacacactttgacaataacccattgagcaaacagcgctaccccacccaaccaactactaataatgagcgaagcagtatgttaactactataattaggacggctttctaaaacttcttcaactttctcaaaacaatgatccattctacattttaagttcaaatttactaacagttagagagtttatacattccccttctctgcagaggcaatcacaacaaccgagacaagagcagaagaagaagttcgaaggcccaaagcgtgagtctatcataaatcttgcacaatataaggacacagaagtacgtgtcaagttcatagggggaagactggtcactggaatcctaaagggttatgacgagctaatgaacttggttcttgacgaaaccgtcgaatatgcaagagacccagaagatgaaaccatcatccacaaggaccaagccaaaaaaattggtttggtcgtcataagaggaacagctctactttcgctatgttccctcgaaggtgctgagatcatcaatacctagttaagacccaaaaaaaaaaaatttcaagcaacagtgtaccatatatgttcattaatagtgctatataacgttcagtgctatatcaaactcacactatgagcccatatccacatttctacctgtatctaatgaaataagtatctccaacggagatactttcctaaccggctacatctcacttatcaagacctaatctgcacaaatgtgcgttcacgtgacttattgaatcttttttctaacatcagcaaagctttttggttaaatttcgaccaaaaaaccgtatctcatcgcatcgactgattagagagatatcttgaattctttaaaccgactgcgtccaggtgttcatttatatatatgtgagtatatatctcttgtgagagttgttcttttaacgtttcaaattctcttttcgcttgttgctgcaaatctgtttgaataatattttctgtagtattcttactctttactgaagaccaatcaattagcgcatcaaagcgaacttcacttaggtttatctgctgctaaaagaaaataatatgagttctacacaaccatttcctaatgtccatctattggcacaatcgaagcagttgcttggcttgtacactatcatcagagatagccttactaagagatctgatttcatattttactctgatagaatcatcaggttgttggtcgaagaaggtttgaaccatttgccagtaactccaaagactattaccactgacacaaaccagaaattcgaaggttgttccttcctaggtaagatttgcggtgtttctattgtaagagcaggtgaatccatggaacaaggtttgagagactgttgcagatcggttcgtattggtaagattttgattcaaagagatgaggaaactgctatgccaaagttgttttatgaaaaactacctgaagatatcgctgatagatacgttttcttgttggatccgatgttagctactggtggttctgctatcatggctaccgaagtgttgattcaaagaggtgtgttgccagaaagaatcttcttcttgaacttaatctgttccaaggaaggtatcgataactaccatgctaaattcccaaatgtcagaatcgttaccggtgctatagatgcaggtttggacgaaaacaaatatttaatgccaggtttgggtgatttcggtgacagatactactgcatctaagcaaactctatagaatttcacgacctgacaacttgcacaatcgccgtcttgtccattcatttacgctaatgtccctcgcttatcgttgttgaccattattgtttacgtacttgcttagaaaagtaaattgttaaaactcaatgcaatcataactcaaaaacagcaattataatacttatgttctcgcatcttttttcactttaaataatctcttcgttaatgtactctcagttttatggcatttacacctttcctctttgcattgaaagcgtttaaaatagttatgatagattatatatccttgttgtctcgtttgttgacttgttttaccgtgaatgtttttcataggaatctggcgtgtacgcatcttggattttcttcccactccttttttgtcacccatatctttttgaacgttgataatccagagagtatcgatcctccaatccatgtgctatattttctttctggtggtgcgaatatcttgatttttgtctgcggttcgcaacttaacttcaactcctttagaactctatcaccaaaacctggtatcattgtagtaccaccgctgaatactatattagaaaatagtgatgttcgtaaatctagatctactttttgtatactttcgtatagtatttctggcaagctttggaattctgaaccgattaactgaggattgaataaaatctctggcgctctgaatttctcattatcaagttcaatctgtttcccatctggcagtctgaacattgtttgttttccgtgcattgtgtagtttttctcttcttctttcggatccaatgctatatagcacgctttctctttgatgattcgaacgatctctctttcgctactcgaaagcaaggaaaccccagtggactttcgtataagaacttgcaaaagttctgatatatcacgaccagctatatcaatccttcgtatagctgatggtaatgtgtaaccatcgtaaactggaactgcgtgtgaacaaccatcaccggaatccaatacgcatcctgttgttcgcccactggcgtatagcgaaagcactgcctgaatcgatacatataccgcaggtacactaaaagtttcgaataataactcgcacatctgttctctattctttttgggattcaatggtgcctcagtgaccaacaccggatgatcttgcaaactgctcagctgtaatcctttttcgaaaacatgcccccatagctgctccaatgcattccaatctgtcacaacgccatgttctaaaggatggcgtagcttcaaaagaccccgtatttcctgtgcttggtttccaacgaaagtattcccatcgaatcttccagccataactttactatatttaggtatccccaccaaagaatgttcataacatttaggtttatcttcacctccaaaccccgcctttattagcccagacccattgtctagaactataggttgattgaacaatatctcatctttggaatccatcaccgttatccctatgtaatgctctgaatgtcatgatcttttcgcgttgttactgtttacaatttagaatgcaatatttaagtaatttgaagtttttaatatggtaggaaaaatgatggcacatatacgattgttaaagcagaatacttttgattgccaaagattttaatatacagtttgatacaaaacataaatatagactataggtaattgtatatagttgatagttgcgaagtagagcttagaatccttggtttccgttaaaaccgataaatcttgtcatcaagaagatattatagtatttcttcttggaaatctggtttgtgtgattccaagcagacgttaatctaccatcaatgcaggaaccactcatgtagaagttatcagcaccagaaccgtcaaacatgtgagcaaacgcgtcctgtaaaattgttaatttcaggtcgtttaccgagccgtattcttttacaatgtaatcttccaagttggcgtcattcttcacaagatcgttgatctgtagtagcgtttgatcgaatgggatcaatatatttggaatttgggtatatttatcaaggaaaaacaatgcattaggcactgcgtcatctccaagatgtacaaccgaggagccaacccaggactcacatttcaatctgcactcatttaaaatgttatgcatttctttataaagagcaggacaggatttgatacggtttaaaccctggcctgtagacgtcaatctgtaagatgagccattgaacagatcctggtcagcaatataccataaatgtaccatttctctttgaattaccgaccacaacatcaacgactgctgtgcataatgccactgtctttcgtgatcatgagttaatctggctccatttctaccatactggatacctaacgagtacctttgtttgatagctggatcacggaatacctcaagtctttcaagtaatctcataattggccttctattagagttgacgtatgcgttgtaatcactaatagaatatagaacttgacggatgtcttccttcgaatagacagaggtactgtatttagaagctaatttttcagtagcagcctctttttgcttgatcattctttggatctcggccctggttttacctgtaggactaatatctgcggtagcgtaaagaattaacttatcttggaaaacagcaagagctctcccatgatcctcacttttcccgaggaaagtatggactgtttttattggtttgaagagatggaactccatatgatcctcaatgtcaggtaatctggagtccattaccatgtagcataacttaccgaatgtagttctcattctgtcaggattcataattttataacgtcttccaatttcgaatatgtctttgaaccattctgcattatcactaaagttcttcaactccaacaatctcttaccgattttcaaattggatgcgatcactaagccgcataacacggaacacatttctcttaattgctcgagtattctctttgattttgactggtatgacaagatatcaacacgatcagtatattctgacacttccaaagcagcttctaacaatctcaataaatgcctctcttcatgtgttaatctcagaggaatgtactgtgaatgtttatacaactgtgctaggagtttatcatcaatcccggtatttgggatgtggacgttggaactttctgcttctttctcatccgaagcgttgttcatatcttgcagtttcttctgttccgcttcctctgtaggagtatcattcttaccatggtcctcttcatcatttaacttgacgaatccatggctttttcttttaccaccacggtggagcatatcgaaacatgtaacacagaactgttcttcacaatcgttacacttcatctcgatcttcatatcctgacattcattgcagtagtcaggattaatctgctgctgagcaggttctactgcttcatcttcttctccacttgatttcgaattctcatcatcactgtcctcgacgtattcggaatcaagaatttcctttaacgtacgctttgatgacatcagcgacataccggattaccacactgagtccttgaaaggcactgtccttgtccatacagagactttgtcgtccatggaagtgttcagcaatcttcgctgaatttcgatcttaacatctcttaaaaagaaaataagtgaacaccatttggtgttcactttggaagaacaaaccgttcccgaaagagacgactatatcaccttccgagcaggcaaaagcgatattgattgcatagatcaggtgtagtcatttctatttgcctcaagcaaaacttttccttgttttatgtgttttgagaagcatctgtgattcaataagtacagcagtaaaggaatctgttttaatcatctatccgggtctcctagttacttcaacatactagtggtaccaaaatttcagctttatgacagacatgcgacacaaggttaaggaaccgaagattctaactcaagtacgacccttgtggtacttttgtttggcagttttatttatagtggctttaagggcatttataatacagaggaatggtgagatagtgcaacagtttcacagactgcttactaaaaatgaagaaactaaccccatatttaataaaattgaattcaaccccgaggatgctaatcctttccatgcccttcgaatggtagtatttctaattacaaccatggtaataggatttgtactcctacactgaaccgcgcgctccaaaaagataaagagatagctgcgattggaaatgataaagcatttatttaatagtaattttataaaagaattgaactttccctgtaggaaataattttggttgctgagaatcagtccctaatagacaaataaagagatttcactccttaggaatggctcgtacaagtcctgaaggagtaatgatgtatggtgtcaagtaatggtttttacatctgcttaacagcaatgcgggttgagtattgtatagttttttgagagaaaacttgttcttagatgataaatcagaatttgatataaacccagatactggtgggttattggtttcatattttggtcccatggagggcgctaatgcgattttgttgacccacgattcatcaaatcctaaaggtttaatgcaacgtaaggaatcgcgaatgtaccgtctgcgagtaatttcctttcgaggcggattccatttcatttcatcgcctccgtaaggagtatttgacaaattactagtgattgaagatgttctccggcgatggatttcagttggaacgtatatatagtcatcatcgctgtcatggaaaatcccctcttcatgataaatggaggaagctgctgaacgtgcatgtcttgtaggaagctcgttagagctagcagcagtttcagtaccgtcgtcttcatcttcctcttcttcttcctcttcttcctcttcttcctggtcttgatcctgttcctcgctatcctcttcgttatgttcgttaagaatagtttgtagctcattgagctcaagacgagaacatatagcattttgataaccagtttgtgctgagaggtcgttctcagtcgagaaatcttcatccaaatgtggaataatgggaattgatcccagatcgcctttatcaaattcaggtgtttgttgtgaagggagttctgtctgttttgagaattccaattccgtagaagcaatagatcccaagcgcttctctggtgtattaccagcagaagtggagaagagaggcttacctgcgactcttttaagcggagttataggagagtctttattcttatcgtcaatgttcgatttcggattggtatcagtaagagggtcaatgtcagaatcatcatcgtcttctatcacgcaatttaacgcgcttgcaacgcttccttgtctcttatgagtttgaacaggcttctttccgtgatggaacatggtagccagttttgatttgattcctttgatggaagattcacttgatcttctttggtaagtgggtttggctgagattgttttgatagaacgggaagaatctgcctcctttggtcggtttgttagcgcttctaacacaaacccagtacttctagtggaggctaaaaccggtcttacatgggcttccgctcgagctccgattgatgaggcggacaggcgtctgctttccattggagattgtgccctggatgattgtccggtccccacttgaagcatccgttgcaaaccaagtgaggtacctccattagatttatttcttcttcttctcctgcgatgaccacgacgtcttcttcttgggacggtccgatatgtaggcatttctctataagccaaatccaacgaaacatctataccaattgaaagggaaacgctccaatctatcatatcatcgacgtgtgcaaaatttatcaaaaattgttgtaattcacatcttaacctgagcacaaaggtcttcttagtgtaatctgtgggtatgccaaactttccgtattgcaaactgaaagatttgaaaagcatgtcattagacaagtactttttttcattgctttgaatcattttggttatccattgctggtctgacctattgaactgataggtgctctttgagtgtaaagaaggcaaaaatcttgtggattgcttggaagaattcaaatcattagggaaatttgtaggccccccgtaataattcttgatattacttgttagtgactcatggatatggtaaaaatttagttgagtagaattaatctccatgataaaattcttccaggccctagatgaagacaattcgtatgggttaagccattcttgtttcagtgaaatcacagtgattgctttaactgcaggagagtaaccaggcaatacattatcatcaagagtttcataaattggataggtgattctcctgtttgaattaactgacttataagatggtggacgtcttggagcattgtctacccactggaaatattccaaacttttttcatagttaggcttgggcctcggtacaacacgagaagtacttttaacgttatttagcttttttttcgctgtttgagtcgtcgatggagtggaagacgaggtattcgtaccggtaaattcctgaacggatcccgaatttgttgttaatgagatatcacttgctccgagggaagtacaatggcaatccaacaaagatatatcttctccagtgttatcagaagatgtatcagaagataacgacttcacgtgattcatccttttcatacctgattctttcttgcaactcggtatacaagtgctatttggtgatgagctccattggccgtgcgacggacgtagtggcacgctaactgaactcattaggttcctgataaggagctattcacgttagtatagcaaaaccaccctcaaaaaggactctggaataataaaatggatcgaagaaggtacgctagatcgagcaacctgcttcaccttgcgacaactgagaatatatccacactaatgttattggaaagtgaatgcaaaacacaatatcgctttctttgttattcaatatgttatcagcaaagatacaatgtacgtgtagtgtgaccaaattttataaatgcctatcaatatcgatgtaaaacagatctcttaaaagacaataaaagatgctgctcttcgaggaatgttcaggtcggtaatgcagcgtacttattagcctaaggaaaggaattaaaaggatggaaaggatggaaggaaaatacaaatcaaacaaagtgaataaataaaaaaaaagataaaactatccccgaacggatgttttaaaatctaggtcttcgttccttgctgcgaaatatgttttcaacacacttttacaataaacctattgggtcttcggcgccttagctctgggtctcttccacaaactttactttcgagacaatacttatgttgtctgtgtaaggtgtttcaagcaaaccttcttttcagtctatctatatttaaattcccgtcattcgcggattaactaactatgcgcgagtaagaaagcaaagaagagattagtcacatgattgtgagtttgaaggaagacctgtcgtaggtgataggaattgcgaggagcgcagtagtgaaacggctttgtagtcgattctgactatgcctacactagataagtggttaaacgatttgcatgtttttcgagggttcatctggtgatgacgacataatgaaactggttcggacctaataaacgtaaggtacagaaagcatagttcaagtagatatttgtacatatacatacatacgcggattttggacaactaacctctgctaactcttttttatgttgtgtatgtgcatgcctattgcatagaattgaagatgggagacgtttctatatatgtatcaaatgttgccctctaaaatcaacttttgtttttaggttagtatataatgtgtcaggagaatgtttagtcttcaggttgttttttagtacaattgaattacctgacctcctttggtagtttcaaaccacgggcaccgaagtattttcttgtgcagaaataactgtcaccccaagtttggtcatcgcctgggtcacatgtacatctgttttgtaatctgatagcttcttccacaggacatgaagtgaatcctggatggtagtatcctatgccgtcgaagaaatggaattcttctggttctaagaaaagtgcagcggcaatggaatgaatcggagcatcaccccatctctcgtagaagaacccaccggaacggtccaagtagtcgaagtactcacggtaggcaggggatctccataattctagcgatgcgatttcgaagttagaccagaagtgacacatgttataagtcttaccaccatcgttggagataaacttcatcaaattattttccttgacgtgttgtgggtattccttcatgaaatttttggtggtttcccataaagtaggaatcgttttttcgtattcgctaacggataagatgaacccgtacttcttgttgttttgcttcattaacttaaaaacatcgtagtgaatatcacagaacaacttgatatctggttccacacgccaataccattcatactcgtcaagtaactcgtgtctccagaagaatccggattcgtatctacacatatgtctgtaagagacggagtcaccgtaaatgataccgtcttctttcatctgttttctgacttctgccgccttatcctggtcaatccagtctgggaaggaccagtgttcctttggaatcacaccaaatttagcggtaccactgaccattgctgtcataacacttttgaattcctcgttgaacggttcatcgttcaaaaagacccaatcgtaatgatagttcttgttgaatctatcttcaacatccctcacagatgtaaccaaatgccataaatctttgtttcttgctaaggtgaccatacaggccttttctctaacaccatcatcttctgggtaaaaaacgttctgaaccttatcagtatgaggcttcaggaacttatcttttgcaccaccaggactcgacactgctggttcgacagtctttggtggaagcactggcgtttcgctgctaccattaccagaacgtgtaatgaacacgaaacataaaaccgtgatgaatgcaatgaacagcaatctaatatgacgctcatatttcttcacaagaaatgccgattttggcatgagctttttcttcggctgcatcttttactgaattcgattaacctttgatccgtgcttacctttctttgattcagtgacaggtacaagacaatgtgaatcggaatatcttaaatcaaatcaaatcaaaacttggaataaatatgaatggaaacaaagtttttaaaagatgatatccacgtatatctcaacgtcttgaataactatattctaacaacccagaataaagtagcaatgaaaccgcttaagggacttcaggatgtaaatagacacttgaaacacgttaaattgtatgacacacatccttagaacaggtgtggattaggtgttatttacatacttctgtaaacttttttttcatcggtgaaaaatcaagaagagcgacacctagaaggaaaaagagcgtcgaaagtgtggagaaaagctggaatgaagatagattcttacagtgaaactactatgttttatttcgagcttctaatggacattccgaatccggtcccaattcactgtttagctcctgtttttattttttaaaagtacacctctgtatatgcgaattataaattaaaagagttcacggctcgcattaatgtgtcaaaatgacgtttcatcggatttactgagaaatttggcccacttatccaaagactggtgataacctagcactaaaggctcgatgtgggacccacacggaaaaatttccgcaatcaagttttcattgggactgatgtggttgatgaacagttcgatttgattcttgaacatttctagatcaccatatgtgatgaacaatttagtgtcgctgagaatttcagtccaagtctcccttggaatcgatgtgaaattcaaatactttaggtattgactgggatcaactacgttttgcatgtaagaattttggaaaaccgttaaaactttcatcgatagcatatctacgttgtagccgtttaacctttcaacgtctacagagtctcggtctaagacgttgcaccatggagatattgcaatggcgcgctttggaattgtcattttattttcgtgacatttcaacaagatgtttaagatcaaatttcctccgcacgaatcgccaatcagatttatttccgtaaacgtctctgtaagctcaaggtactctttccacacatagtcaatcgtctcagggcaattcgccattacagggtaatctaatactagtatggcaacatcatcgtccaattttttgcctacggtccagaggacgattagcatccacggaattaatccaaacatgaacccaccaccatgaacgtataataacaatttcttgtcaacaccaggttttctatccactggtgccgtccgaagccagtatccactatggttgtgtttggggaaacggtacgcctggaatagtagccaagataacaagcccatccatggattcaaaatatatcttatgatagcagggttactggcatcgcatataactcgagtcaacgtcactaggaaaagtctaccgcgaggcatagaggtcttattcaaacttctactccatttgcacagcgcaatcggtaatgcgcatgataatataacaatacctaccaaagtttcttttacagtcattgtatctccgattattgaacgatggtctaaagctccatttagatacgaagcagcggccttagaccaagttttaaaaagacttcacactctgctaattaggtgctgctcttgtgctccaataaatttatatagagagcacactgctttaatgccttatatgcatgtctaaaccctatttatcggtgaatatttcctgctttaagtatgtagtagaagggtctttttctttcgaaacttgattccttacattaagaaattctgatggaatcgagcctcgagtgaaatgcgagaagaaattaaatatgttggggaaaaggagtaggctaccactagaaatacagtatcagcttttgttaacttcactttaacccctgtacgcattttctgactgttataaatgccgagaaaacactaaaaagatggcattttatcaatatcctgtgcccttatctgggacaagcatcgagaacatagtcagcaagtacgcgggtcatcccgataagttgaatgagctagttctttccaacgctaaagacttccataatgagctgatcgaatcacacttagagatggtccatttgccgttacgagatatagaaatcaggatccaaacttgtcataatctagggagttacaaatctaaaagtgtggataagctagtgctcatgattcatggactcggtggtaacttaacacattatgagccgcttataagcaaatatgtacatgatcacacaccattccttgcctttgatctaccggggtttggtgattccgacgaattggatcaatacaatatgggcgacgttattagccttatatgcgaattagtacacaaaatgtgtcaatgcaagacgatatcgataatcggtcactcgatgggggcattgttgtccgttcaggtagcgaatacgatttctgtgaaatgtcacggcttaattctgatcgggactcctccgttgcagaacaaggctttgaaaaacccatttgtaagacttctcctcaagttgctttggtatcatcctggcattttcgacttttatagggttaggtttgatcagagcaaagggttgaaaagtagtggtattgtcaaattctattatcgcgcgggaaacacttacggaaaactatatcaatactacagaaatatccaaatcaagtctaaatctcttgttggttattttcttggatggcaggaagtttccaatgtaccaaatgcaactccgattcatttgatacatggcgacaaggacacgatctgtgcagtggaaaagctagcacaatggcgcacattggaaggagttactgtcacggtagatgtgatcaccgattgttcgcacaattgtttattagatgcaacagaagaaactctggagctaataatgaagtatacatgaacgtgaaaattggaggagtgaaaaagtcaaaagcagaatcaaatcagatgcacccaaaacgtttgagggatattattatctaacaaaagggtgaagtaagaagaaacctgtctttaaaacttatacacacagtgtactatcacacacgagtctaaacataatcagagaaatatatagaaaagataatgtgtgaaaaagcaagcacatagattaattggtttttatttcacttaactcataaacttagggatgggaattaggacatgcaatcagtttcaaacggatggactctgtttaatccaacttgatcctgacggccttgatttgagtgtaagattcgaaagcttcttcacccatttctctaccgtaaccagattgcttgtaaccaccgaatggaacggcagcgtcgaaatcgttgtaagtgttgatccagacggtaccagcttttagtctctttgcgaccttcaaggcaacggagatgttttcagtttcgataccagcacccaaaccgaattcggagtcgttagccaaagcgacagcttcgtcgacagtagagaacttggagatggtgacgacaggaccaaagatttcttccttgacgattctcatatcttccttaacgttgtagaatacagttggtttaatgaagtaacccttgttgcctactctttcaccaccagtcaagatagaagcaccttccttcttaccgatgtcgatgtagttcaagatagtttcgaattgagccttgttgttgatagcagcttggaagttagattcatcgaatggggaaccgaccttaatttcagtttccaggtaagtcttgaattcagacaatagttgatcgtagatggtgtcttggacatagattctggaaccagaggaacaaatttgaccagcattcttgaaaataccgttgaccaagtttggaatagtcttcttaatgttggcatcttcaaagaccaaatgagcggatttaccacccaattccaaggtgaccttcttcaagttagattgggcagccttgatagcaacgtctctaccaatgtcagtggaaccagtgaaggcaatctttctaatttttggatggttggtgatggtgtcaccaacggatctacctggacctggaacgatgttaacgacaccagctgggatacctgcttccttacacaaagaagcaaagaacaaagcgttcaatggggttggggaagctggcttcaagataacggtgttaccagcaaccaaagcaggggcgatcttccaagaaagcatcatcaatgggaagttccatgggatgatttgaccacagacacctagaggttccttgtaagtgaagttagcgtaaccatcaccagtgttgatagttctaccacccaacttgtcagcataaccagcagcagatctgatgtagtcaatgaccaaaccaacatcacctctggctagggccaaagtcttaccgttgtcagcagattcgatagaagcaatcaattccttttgagcttcaatcaagtcagccaacttaaacaacaaagaaccacgcttttttgggtccatagtagaccattcggagttgaaagcagcatcggcagcttcaacggcgtactcgacgtcttgagaagtagcagattggacttcgacaatgatttcctcagtagatgggttttcaaccttcaaagtcttaccgtcttgagacttgatgaactgattgttgatgaacaaaccagttggttgttggtaagtcaaaccgtttggcaaagtgatgctaacagcgtcttgttcgacgatcttgaggttcaatttctcagcaattgtagaggacattctctttgtaattgttgttggtgttatggtagtagcagttgtaataaacttacttgcacttaatgagtggacagatgcattagaactaatacatctaatcaatcctttcttagaacaactcctttcaagagaagctctagtcaacaagcgcccagtatttatacaagttcgaatcactaaagaaagggggaaatgtggcgagtcattacgattagctgtccagatatttccgtcgtccgtctccactcatgcttctttccctcttcttcactcatactctgtcgtaattatttttcagctaagaaaaaaaaaagtaaccggaaggaaaaaagccctaggaactgcactatgtttgacaatcgttagttatgaaaatcatgcagagcaggaaacaattgaaccgaaccgatttgtaactatctacagtatgttgggaaacgaaatgaaaagaatgcaccccctcttctctcagttgtgtttagactccgagagctagcaattcggggaggggaattggtatggtagtgttcagtaaataggatggggtaaaaaaaaaaagtagtcgctaacgccagattgacagcactaatccactgtgtttctgaggctattagtattactcattcaaaacccaaccaatttctggcacttaacaccgtgatctgttgtttcaaagaagaacaatcctccaattcacgcaaaagtaccggtgctatttcgcccagtatttactaatagagagagtcaaagatgaaaaggaaaagcggtcttcgttcaattgatctcgattttgagaaatactgaaaagtacgcagaagacgatgtagagaggacgtcataggaaatgacaaatggacaacattaatggcagatggaaattgttagtaattaagcagtgggggaggggaaatcattaaggtaacgagactacattaaacttgacaccacagccagcaactcaatgggtaatcctggtgattcattggtccaggccaaatcaggttagacagacaggcacaggaagtaggaaaaacgagaaaaagaaaaccaaaaaccggcttgcacgtcgtgagaagtttcacattagtcaagacactatccgattcttgccaaataaactgagtagttcgaggcatatcttgacattgtttggcgcgcttacctagctggctggtctaacggaaaaaaaactccgggtcaaaggatatcaggggagcaagtgaggggcaattgtcgttttgtacgatgttctcccaacactcagaaaaacaaaggtttctgctttctgttggttttcttttagtttttcggctagaatcgtgcgtatcagaagtaagaggtctggagcctctatggtattttctgtcgctcagaaacagttacagcctgcttcggttactgaaaggctaaaacaccagtaatggctgaagtggggtacatgagtttctgcagaaatagtctaagtttgcaacggttagaatgcttttttttgagtttgactggaagaagagtggggagggtaggtcctgggtgcgatcgctgatcccgggctaaagaacaatataatgtcacgtgaatgttcccgggaatggagagcaggtgggtgcaggactgatacaaaacaccttaagagccagttgatttagttcattactccgatgctactccgattaatttttgtttttgcggtttgacacaatccacccgttttactctcatttattcagccgtacgctattcaacgtttcccagcgatgaaactaggttttccttggctgcagagttgaaagttttggaccctccgaagtgagaaaaaagcaattagtggattgatgcattcgtcctcccaactgaaagtttcctccgatattaaacatctccgtttaattgaattcaggaccgatttctgttaccggtgtccattgctcctaaactggaaatgacgaaacccatttttcaatagtcatcagtgaatattcgtaagatccctttaaaaaaccaccaaatctaccttgagatgaaagttttcggtttcccttgcaaaaaaattaatacatactagtttgatgttcacgtgatatgtgtggtttcttttggtttcggtgttttctctttttctgtttttcgattgaaaatcagttctaggtcacgtgcgactaatttgaaagaaaagaaagtgaaaaaggtattaccgaaggtctgtgtggttccttgcaattgtaaaaaaaatttcaagacaaaattcaataagaaagatgataagacaatagcatgtccttcacgtccgtttcatgaaggcccagggccagtcgtatttatggttcccacaatcaacaacaacgaaaatttcacatcgcatatttttttcctggccctccgtgtttgtgtgtatatgcatttttcttttctcttttttctgtttattcacctataatccatattactcatacttgcgctcttcgagagatatactggaagcagctattttgacatgaaaatgaatacgaaaagaaagaaacagaaaagaaatgaaaatatgaggtactggtgtctctattgtactaatgtacgccgccggaaatttagacttctctctagcgcgtattcgagacctcaatctgcgaggccccactgaggggcaggcgctttttttcctatttggtttttttttcttcctcactgatttctgttgtttctactgcatgttcactgtagaaattgggatcggttttaaaagaaaaaaaaaatttatgctgtttgaatgattcatagtaataaaaggaagctacatattttgacttctggtttactttttaaaactcactgtagtttctgagtgatagctatcaaatcaagagagcaccaagaccgctcagcggcaaacacttgtgcatcggtttactctctttgacatcccccattggccttgttttagttcttgaccggtatcgggaaaataacgaatctaagatcataggttacccggtcgttgttttcttttgtctttctatgctagacctgcggtagagaagaaattctctcctgtgtgttgtaatagctgattcttcctgaggttagagaccctttctaaaagcctatcggagcactctttcaatttaacgtctgtaatggtgtccggtttcccattttcaatctggatcgttaggtagacattgttaacgtttcttgatatctcatatttgtagtgtccggtatgagattccgttattagcacttccccaacacgagtatatgttggtgattcctcactttgtatcacgtagtgtagttgatcacaggcccgcgctagatacactaggtctgcgggttgggatactctccgaaaggttggtatccaccttaattcgaaccattctagtatctgatcatcgctgcagttatttgtcatatcagttatcacctgtaatagtaccatcgctttcaataggccttgaccagcaagtggtaagttagtttgtaatccactcccctcgaaattcatatagattttgtcaagacaacgatcctcgattatgcaactttccatgctgtggacaatgagccttttcatgtccctttgcattaaccacacaacattccctacgtttaaatgcttcatatgcttcagcgatagaattgcttcgcataagtcgtcatttgttaagattttcaactgaaactttttgcgagatcttcgtctattggtgaacatattgttgtctcttgatgaatcgagtttccatatgatcgactcatattgtgtgtccttgtaataatggtatggtttgtcactatccgaaaagaatttgggggttaactctctgtctccattaaaagtattcaaaccgtttagattttcttcttctgtttcttccggaaagaaactgacataaccatttctcttgtattccagttcctcaatttcaaaatcaggggagaggctcaaattagatagattaatgcttttaaggttcacacataacgtcaataaatgtataatataaccaagcggtaagtcgcggagatgcgcatattttaggaaaaatttgttagtgaaaggtaaatggcttcgcctgagactacaggaatcggtacctgcagcaaactgctcatctttcaattcaagtgttgataatccactaccattgttctgatgcaaatgtgtcttttgttgtccctttcctctgaaagaattggaaaaaagctttcgaatcctcttcacgacgtttttactaccggcagcagtttgcgttgatcttgaaactagagacgtcactgaactagatctagttcgattatagttatgtgaaaacacactggagttcatggacgaagcatcgctactccttctcgttcgacttctgtgtatactactcaacatctctgatccatacaaagaattttttctatacctccaatctctccagcctgcgtatgcaatatcaggtggttcaaatccgtaagaactttgtgaaacatcgttctcaagagtagatgattcgtcattgataaatccatttttcaactgtgacaaatctaatgactccacatatttcccatattgaggattttctctcaaagttgtgacaaactgaccgacacgatacgtgctcgtaaacttgacatccttgtaaataattcgtttagcacattcagaccattcctgagacactaacagacagttacgctgagaatctgcgtcattcaaattagctattatcctacagattatttcttccggtaagcagttaatgtcggcaaagtcaacttcgtgtctccgcttctcgctatgcagtcttacaagaaaagcctttgccttggcactagctttcggagcattcttcttctgcttcagctttctactcttccactggctcgaaccttgcattaatgacatgtatcttttcttgaacccgtctccactgcccttatcttcctcctcaatcgtgcttgcagcagaagagctgtacccgtataacttatcatacactgaaacaccataccttgagtagtctgcgttcaaaatgtgtacctttccggtagacataaggcactgggtatcgttatctaatgctggcaactgttctgcttctcgcttttccttcactgtctcgttggcgcttataaggagatgcagtgatctgtaagaaatccctgttttgatcctatttttatttgtttttcccataacatgctgtcacacagttctatgaaaaaccttgaatttttttttggggaaaaaaacgttaggatctgctccgttcataacggtagagcctggtaagatatgtggacgaagcccatacagccagcattaacggttcaactgttaattctttttagtattagtcacgcacgttaagattcaaaagcattacatagttttatatatttacaggtgacaatggaacgcctcttatatgatgtgatagagtactaggttacgctccatggcaacaaaagtgatgaagaggggtacaagatggaaaagtgtttctgtttttgttttgtgtaagttgactgaacatcaaatttgatcctcaaaatattcttaattatcaattttatttgcttccttgttgagcctttagtttcttctgttcttcaaactgagcctcaatttcctgttgtttttccatttgtagcttcagttgttcttcgggggttgggatgttaccttccacgtaatccttcaatgtgaaagtctgttgtcccatagcttgttgttgtagcttgatcttttccttttcttcttcgactaacttcatgaatctgacgtaattcttttcaccttcctctctgatcaaatcaagcgggaactttggcttggtaccaattaaaccgatacccaatagttttagaaacaagttcttatcgttcttgaccctttcgtcacgttcgaatttttctttcaagacttggacacgcttttcaaaggcttctgggatgttcttgttgtctgggaaagacttcaagattggcctaacgtcagaaacttgttgggttgccaagtattccaagaatgggattaatctcaataaacggtcatcagctttaccatcccatggttctaggtatatagcattttcaggttgcaatttaaacgaattctcatcagtgtcaatgatcaagactttacccaagtctctgttcaatttcgataagtccttgatatggacaccatctttgtacaaacaatgttctttgaataggttgtaggtgatgaaagcatgaattgggtcaagtttttcagcaattttttcggcatacatcatgtagttagaagagaatagcacgatttcatagtattgggatagatagcccaaaaagtaatcaacacctggcctcttagcagttctccagccgctttgttgtgtccattctgagtgaaccaataaatcttccaaagaaaggactagtgtcaatggcctttgatatggtggtggaggtgggggtggtaataaatctgggaaaggaggctcttggaagaaagtgaaaatggactcccaacgtcttttcattctcttgtacattagggcaggagtataaccatttggaatttccttcttcaactcttcactttcatcggaatcccagtcacgagccatagatagggcaccagaagctaaaccaagtagtgacaggatgtaaaaccaattagcataacgctcacgtttaatatctgtggacgattttctcgatctcttcttcttcccggagcccttatcacctgtagaatcatcctgctctgcagactctcctgcctctcctgcccttccactcttgtctttagatccggcttcattaccttctacctccacaccggctctggcaagcatgtcgtcatcaagaatagattttggagcttcattcttctcgtttttcttctgcaataacaggcttccattgtgtaatgatcttctcacaacaacaggtctcatttgcatggcatgcactgggaccatgcgagcattgcgcaataatgacacccttgctatcgacaacatcacttaaacaagtatgttaattctgattcttacagtaccctaaactagtggaatcgatcctttcctttactatatagggttgatattgtatttttaggtatcaggactagcttcagaaaaatccagataggaatataaccttcgaccgtacaaactacttctaaacaaactcgttattgcaaatgtggaaaggttggtttatggttttctgcttttaccatttcgtctagctccttctgcatttctcatagtttctttcaaaaattttcatgtcaaaacaggaaattgtgttcacgtgactcgcacccaaagttctccccgcagtcatcagctgtgcctttgattcaagtacgtatgtgttttatatcagattattctagtaaagtgtaaaatgatttatatgcactttctaatgagtatagtagctgttgagaatcggcatccgaaagttgctcgtccttgggtaatttattgattttgactatccattccactaacttacttcggttttcgaagtcattactggtgaccctatttatacttagcaataactccgccattaacggatgaagctgttctctggtcttgtaatttagtttcaatgcgtccattacggtgatgaaatttcctgtagcctctgcaacacgctttccactgtatttatttaagtttgtggtattatcggccgctctcgaattgtccaaagaatctgtgtcaccgctggttccatgttctacagttactggaatgcctctctccagccttgtgattgcattggaagccgtaatttgccattttgctttaaaatgatcaaggctcttaaactgttcctctacatcttcatcactgagatatgtcctgtattgatttattagcttattggcaagccgcgtgtattcttcactgcctatatcgtctttcaaaaatgctttctctacatggtcgagtgttattattattgaatagatctcgccaagagtatccacgatctctttttcccttggttgtgcattcaaatcaaacggctggatttcctctaaaagctttgggtttaacggccttgtgctatttctgcttccatagtggttcaccggagccctataatccgacattgcaaggttttgtgtagattcctggttgctgtttcctatgtgctactggtgagacttgtttttattgatgctaagttttaaaggtacataatccatcttttttcataaactaacataaatgttacaacagttattcatttcaatacgctatatatgtatatttaatgcattaatctattacgaacacccgccttggtatcttcgattcagtgttatatagtacgccaagctgtgtcaggcactctttagttggaacgtaaattacaggcgggagaggtggatattctaattgtccgtttttgttacgcttgattccaccgtagttctgataaaaactcttagcgttcttggctatctcacgttcttggtaaattaattgttcaacgtgcttcatgtatgacttgggccaaggggtaatatctattgggtaagatatttcaaaatccttacctttagaaattttgaatttaatgtttaaagagtgggtgaccgagaaaagtttacctctagtggtaatggaacaatgatactgaaaaggttctttactatgtttacctttaagaacaacagtctgtggcggattaatttggttcatttttggttcgtgagatggtaattgatacatcacggcaggttcattcaaagaagtttcataagtatggaacaaagcgttcttagttagcactctcaggctcatcttgagtttcattccagattccggtaatggatcattgaaaggcttagaaattgactcaagaacgttttcttttgtatcagaattggcatcataaagctctaaaatttctttcaattcaagagttatcccttttaacttgatctgtttgttaaatatacgttgactttgagtgtatgaggtcagattcgggaagatttctagtttgagagtaagcaaatcatctgttgtcacgcaagggttatcagtggtcagtttgacgtgaaatttcttatcaggtgactgtatgactttggtcacaggcgaatataacctgggtgatgctatcaacacgtacctttccacattgaccatttgagaaaaactctgcactaaaggggcagagttcgtgtttggcaagtgatacaacacatcacattctaaaactgtataagaatggcctgctttagcgttatagtttgtttccttaatatcgtctggtaaagcaatcgttagtggaatatcgagccctattattttcttatccgatatgcgcatattcttcttataatgcacagactcgctctccagcttatttctcttcgaagtaaacgatcctaaccccatgttcaaacattctatagtcttcaaaaccatctgtatcttatcaatgatgaagggtttaccatcatttgatcttatcctcaattcacattcaattcgcggaagagtgtccggaagccctggacaacctcgaataatcgagttataactcggtttaagtgatatcactgggtaagtcattgtcatattctcatttgcccacaagctgtgatatgtcaaagaggcttctaacaatccttactagctattctctgtgatccgatatgagatctagtatgtacttaaattaatgtgtttatgaaatggctggacgttccgatttatatggtgttacccggatcaatcatataatatcaacgtcagtatcaatggaacaggacagaggacttctggcaactatatattgaagactacacatctgatctggtgtctattggtaacagctgctctgtcttttagcaccgctatggtatattttcgtcccaatttttcttaatctttatctatttcaacaatttgaaataaaaagatgcttgtagaatttaacttcctgttctatatgataaaaaaaactccagaaagtgacataacatgggataatactaattcagtaccgaacccttctctctggctgcatgcttaattattttcaaaaccatgttacagaaaaaggcttctttccaatggctgacagtttttttgtctcgatcgtgctaactgggaaatatccggaaaaacctttacgagccgactaatttgtattcttgaaaaaggtatctgtgaaccttataacctaattgaatctgataatatttaagttccaaaaaaaatatttaaatggcgtcgcatgaatactctttcctgacaccaactcccctccaaagttcaattaatgcactccatctgatttataaactttatttatttagtaccgtttttatctgtcaccacaacatttcttttttgccaagtaccgctttatcagcctcgtgaggcagaaaaaaagatttgacagatcgacatatataggcaagttgcattgaaaaatctacacaggaaagttttactagtgattagttatcgaaatctctaatttggttggttctgctccacagctacactgctagatttaggaattttgatacccttgtaataattatggctaagtttgagtgtactgacgaggtgaccaatttcctgacagaattgcctaagtgcgaacaccatttgcatttggaaggtactctcgaaccagaattattgttccaattagttgaacgtaatggagtacagttacctggtacgtttcccaagaccgttaatgagttgcatgtgatttacaacaattttgctgatctccaggatttcttgaactattactacatcggttgcaacgttcttctcagtgaagacgatttctttgagttggcttggagttacttcaagagagtaagcactcaagggttgagacacgccgaggtgttttacgatccacaatctcacacgtccagaggcatttctttggaggttgttaccaaaggttttgaaagggcttgtgctaaggcccaggaagaatttaacattagtaccaagttaatcatgtgtttattgaggcactgtcctgtggaagaatgtatggatactgtgaaaagtgccaagagcttgattgaatcgggagtcattgacggtcttggtcttgattcgtcagaaagacctttccctccagaattgtttgttgaatgttatcaattggcgaagagttacaataaggagctgcaacttacagctcatgcaggtgaagaaggtgatccaagttttgttacaaacaccttggacttattggaaacaacaagaattgatcatggtgttagaagcattgaagatgctgaattaatcaagaggttggccgctcaaaaagttatgttaaccctttgtccattatccaatgttaagttacaagtggtaaaagatgtttcagagctaccattgcaggagttcttggataacgacgttcctttctccattaattctgatgatccagcttattttggagggtacatcttacagaactatctggaagtgtattccagatttggttggtctaaagcagtttgggctaagatcgccagacaaagtattgaaggctcatggtgtgatcctaagaggaaacaagaactactctctgaggtttcagaagttgtaaacaaatatgtaaacttaccttagactaagtagtagatggcataagctaggtttatgcacaaaatagatagattttgaattcgacaaattaattttggttttgaaagatagactgtgattacttctgcatcgttcagtctatctgggagaagaggcacattagaagttacttaaacgttagtatatagtaatacaaatttgtcgttaaactaggtttaaaactaaaataaggaataaaggcattattggatcaaaacagattagtggtatgcagatagtcaggtattattccatatcgacatcttcatccggtgtcctttgcgtcgaagggttagttatatcagaattgtcttccgttgtatcatcaatatcgtcaataaatagcaaggtgtttccgtcttctatttgatgccaaacattaagatactcatactctttgatacagcttaccagttgcagcatagtgaaacctcttgatctaatcgttcttacaatagcatcatacggtaatcttttattaaatctaccattttcagtcgccattttcttgataattgtgtaaattctggttgttgggttttcatcttcatatgggttcttgcggtcgctgtataatgactctttagagacttctaccaacctcaaagcttcgtctacatcttcaatttccacagtgtcactgagccttagttttgccaaggcctgtgatagtctgataattgcaagtaaagttctaggtgttgcttgcccaaacgagaatttagaatccaacgctttcttagagtcttgtctcattcttgtataagatagaactatgtgttcattgacatcagctgacaacacaggtctcttagtcttggcgtatgcaatatactctctcatttcgctcgaaggaattggttcgaaaccaaaatcaggttgcctgtcatacatatgaacgtacgtgacgtgttctgctaacttctcatcgttttctttgcttggcatatcgagtagtaaaaacatgatatcgaatctagacaaaagagctgctggtagattaatattttcaagtggagataaccttggattataccttccgtatagcgggttagcagctgccaatatggaggctctggcatttaaagtagtgttaatacctgccttagaaattgaaatggtttgttgttccataacttcatggatagcagttctatcactttcatccatcttatcaaattcatcgatacaacagataccgttatcggcaaggacgagggcaccaccttctagcaccatttcatcagtcactggatccttcataacggcggctgttagacctacaccagaagaacccttaccagttgtatagacacctctcggagaaattttacagatagatttcaataattgagatttagcaacaccaggatcacccatcaagcaaatgttaatatcacctctgatttttagaccatccccgacttttttttcaacaccgcccactaataataacaataaagatttcttaacatcgagattaccgtaaatttctggagcaattgatttagccaaacggttataaacatcaccttggttgacgattttcgctactctttctttcaattgatcatcaacttggaaagatgcgaattttttcttatgctggtacacaaactgtgtctctaggtacgtttccgttaatagaccagctttcaaagcacggaaaccagtgtatggtgaaggtagatatataccagtaacatctaccacatcacctggaatcatggatctagttaatggcccattaatgtgaatagttaatgtccttgggatatgcccgatgggcacttgatctgatagttcttgaattttacattcttggaatgcactgaactttgatgccctagtactcatgaacaattgtcccttagtttgattttcggaacattgggcagagggacattctattattggggtaaaagttcttttattaacttcttggaacacttcatgaccgcactgatcacaagtataagcgttgactgtgacacttggcttcacatcagagactctggtaatgataccacggactgtaatcaattttcccaaataagagcctttaatttctcttactgacattggtttcagtttcctagtggatctgctggttaacggtttaaaatacaaatgatatctcctaatcaacgcagcagggaacaaatcagcgtccgtagtggccaattgatccaaattggtttgagactcttcgcccatcccttgagccatttgttggaattcatctctagtttccaagatatttctttcgtttctcaatcttcgttggtgtaaaatgacgtccaatacatctgtttcgtaatcgatatctttcgttggaggcggcaatagttcatctacacagttggagaaaagttctgtgaaccgcttagtgttttccatgatgatacggtgtaagttaactaagttcttgccttgtgctgctgtatttgacgaagacaaattttcaaattgcttggtgcgctgataatggtacacatcgtccaattcgatatacaagatatcttgttctctattggcaatatgttgcaattgttgcaagtactttgggccctgaccaacttcaggatccaagttatcgtcattatcgttctccccagtagaaccgatagtttcctctttgtaatggatcaagaaatctttgatattatcttgagctacctcgtagtcaattccgagatccagtgtgggcaaaaccgatgaagccatggtactggtggtgttctgaatcgttggttggtgtgagtggcagcagacagtaggaaaactgataacggagaagttgttgaagattagcagaaagtgtatgcgtaaatgtttcaaagatcaattggaaaaacgaaagtgatttttattttacagttcctaatcgggtagaagatgaaagacgcattacccggacacaaccacgtgacaaaacataccaacataattaccctccctcttatagtctatttttaatttgaaattgcaattcaatttttcaattttcagtacttttcataaacgaccacattggcttggctggacccccggtatagagaggcagtaacctcaaaaattgggtgaaaacaaccttaacattgcattatctaagcctaacaagtgttcaatgggccaatcgagtggacaatggatatagtataggaatttggcattcgtaaatggacaccccagtttcagaaactgaaattcaacatttcccctcgctcaaagtgtaccgccgcccctgccctcagggatagcccttggtaaacgagaggtatgtcatcgcaacgcgtaaaccaggtgtaatttattacctccccgccccccataaattgtttacattttacgcgttgtaccgtacgtaaacgtcaaaaaacgtaaacaaacgcgtaaaccgcacccttaaatttgagaaatcaatttaaaaaatcaatttagctccttcccagtttacgtgttgcaaaaatgcactacatacggaccggcataccaatagtttacagtttatgccgttaaacatcaccgaagctaatgtttattattattactactgtgtggaaaagggtacaggccccggcacagccctatgtgtcggcgtcgttcacaatgacacttagtcagaccacatttatttcaccgtttctcagtccacacactcaagatttcgcacaaaactctcagtcctacacacgtttctaagatgcaaaagaaaaagccaacaaaaaattctcaaaataaaaaaaattcgcctagctgagtatctgcattgtactgtaatgtaccttaaaactggaaatcaggttagaacagctgtctcagactgactttctgacagttacctcgttatctttagcattttaactgtttttggtttgacttttttatgcttcgtttagcccgagattaatatgcacacagagtgttagtatcgttacactaagatggttttcggttctagttttatatataagaagtatgaaatgtgaatagttgaagattcggttcttgtgatagagtatattttatattaggatttaaatatatgtatgtgtattgtcacgaggttaaacacaaacataaaactcaaactatatacatatacacctattacgagatgattgccagtacgatattcaagagacaagcttcaggtttcgctacccactctgtgaagacaaataaagcgtacctgtcctatttgactatgggattcaccattccatttgtcgtttcatactattcgacttattctagtgctcaggatgagttgaaaggaaggtcaaatccaagattatatttcggaaggttcctatgatcggtttaaatcatggactacttgtatgaaaaaggttgcaggacttatgcctttttttttatgaatagttttttcccctcctttccccgacttcaattcaatatcccttccgcgactattctcttctctattttatttcgacggttaaattaagagtcaattatttctctagactctctctggttatggttttagatagatcatcagttataactatatttttataatgtaaggaattatactttttcactaaatttaactcaatcttctcttctctcatactttccaggtaataccactttatgactggaatgacacaaagagccagtaattagccaaacatgaccacgtcaaaggaccccattacctgggaacagagtaaacattatatcaagaccggtgagttgtacaagttgatccggtcaccggaaattacggccaaatatcgcaagcataaatccgagcttgaatctaaaggccaagatttggtctcctttatcctcacttccagattacactgggatgtgaaagaattgaaccactttaataatatagctttcgcctcggatgaggataagattaaaaccttgtttaaggataagactacgttgaagattcttacgaatgattacccttataatctcgaagattccatatctcatatcttgatttggtccaaaatctatattccgttgtaccagtccaacgtgaacgcatcaacagatgattcagtcgttatgcaatcaatgaatacagaagtgaaacaactaatcgagaagtttttggaccatttgcttaaaccattaggtttaacggactatatttggtttatcaattatccgagattgcaaagtataaagaccgtctcccacatacacgtcctgatcaaatccaatgataaagatacagttcagagacttgtagatgacgattcgttactaaccccattaccctcagagtgaaagtgtatatttgactaggtatgatgtatagtatcattctacctttaaataccatacacgtgacctcgtacctttatactggtattagtttctttttgttgccaaaaatgtagtctcgaatggcgatgctcatctcaagagttcagtagttaacggaacagatgaggagtattttagctgcttcagaagatcatctcgttactatatacagagaaaaaagtgcttaacaatgcagctgcgaagaagtacgcgtttacgcaccgtacatactgttaaaaataacacttccatcaatgaggatcacagtttgatttctgtgtcggatcaggtatcagagaaacctgaggacagatttgacaaagtagatcaggactcagatgatgatgaaaatggcgagcgtgtagcggttcaagacatttcctttgacgaggatgaacgaatgcagagcagaacaggtcaaacttccgctacgactcttttgaaaatctcaagacctgaatataacccacaagatttgaaggaaactattcatgttgatacgcattttgttaaccagtttaacgatttgatagagaaacaatctactttgtttttcaattccttgacaagtcctgaatacgttatatataataacttggaaatattcaaatatccaagtgataaggtgagcttgcaaacaatatcaagacagttgactgaattactaccagacttgaacaagaactacgataccgatctgaaagagctgttaaaacaattgcatgaggatcaagaacgagaggaaaacttgaaaattttaaatcaaggtccagaagctgaagtcttcaaagacccattacaatcgctactaaattatcaacctgatgtgaaagaatcagacgaatcaaaacttatagagcaagtggccaaaatccatgaaatcaacatttccgatatatctgacatccttatcaacccaccagtgcggacactgaagagagcattgaatgtgaacaaccaaacaaagaaacatgacatttcccatatttccaataaatgcagtagattattaacgaaagaacgcaaccattcattgccatggcccgttaagaagaaaaagaagcaaacagattcatcggcaatacatgaagatgtctcattaatgtcatgaaaaagagatactttaaaaagttatttcactgctatacaccgtgaaattatcatataaataatgtcatttaagaaacgttcatatataaatatatacaaacacatctgaacatagaactttcaaatattgagtccgtacgtcttgctcattgcctcgtcaatgaaatagagcagatgaccaggtatgatcaatgctagcgcctggcgcaactccaacggtgtcaaaagatagataagggctatggaggatatagggatccaaactacattcaccgcaacgttaaagacaaagagcgctgcgttattgctcttttttgaaacgtagtaccacatattaatgcccaaagcctgtccaatcgacaatgggagatctgagtatactatgaaaaatacgaccgagagataaagacagagtatcttcaatgcaagtttccttttatcagttgtggtctgttctatcagctgtaatgaagataaagcaacaacagcattgccgatcaggtctggagaaagtttgatataaaataaaccataaatcaaccgcagatactgcttcctgtaatatactgcatcccatgagtaagcaacgtcatagacagtaaggaaattgcaccaaagtgccaagtttaacatcaatattccaatgccccaacatctagttattataggaatatctcgtataagatccatacttctttatattcttaaggcacagttcctttcacagccagcgttattgataatgtatatcagatgattaacttccctttaaagtgataaaaagatgccagtaagtactgaaaggcacttttataagtagttaaagtctttaaaacaacaaacagagccgaatactatttctagtatgtatatgatgcaccgaaaaacgaatacactggtttatatatcacctttcttgaaggtgacttgttctttccaaaggtctcttcaatattcaaattggaattcctatttttttttctcgtttatctagcccatacgttgatccattcgaattgacatatcacgaactgaaactggtttctactgtaaagatatcacacatgtacgtatatagggagtaagcatttgagaaccctgaacaacttgctgttaattcgttgttaattattggtattgagctaatattttaaattgattatagaactgtaacaactgcttaatatatgtcacataccatggattctttggatcagattatttacaatgatacattacagacaacgaaaccagttacagagccatttgagtacttgttaaagcaacaggggaagcgggtgaggacacttctaatcgaagagtttggtaaattatatgaggtaccgaaaccgtctatagatgccgttagcgccttcatcgatgagcttcataccgccagcttattaatagatgacatagaggataatgcagagctcagaaggggtcatgtagcagctcataaaaaatatggtatctggaccactttgaacagtgctcaatgcgcagtttatgtttctatttcgaagttgttggctaaagagcatgaaccatctttgccatcaattatcaacgacgaactaatacggcttcatgtgggacaaggtcaggatatatactggagagatgatgggattgttcctagtgtgaacgagtactatgagatggctaagaacaaaactggaggattatttaggttaatggtgagacttttacatgccttgtcgaaaaaagagcttgcacagaaatatgatcttataccgttagctaatgcagctgggatcttgtatcaaatacgagatgactatttaaatctattctccaagacaatgtttgaacagaagggattcgctgatgatctaaccgaggggaaattttccttcccaataattcatgccatagctagttcaaggaatgaaggtgataacgatgattatgtccttaaaacagttttatcaaggccttcagagattcgtactaaagagaaattgctcagttatttggagcaccagacaaagtctggtgaatataccagacaggttatccaaactcttgcacaaaaagttactactgaattggttccaaaggagctttcttcagttaaagatatattgtcgaaactctcccagttagactaattctattatattgattacgaccatcttatatattaattcattagcttcctcatcattatttatttttattagctaaatcacgatatatatcaaatatactttgcatatcactaaccttcaagtcctcgaatttataatccttgtaccttctccaatcggtagcaggaccctcggtaacctcgatgcttggtagcggtacctgtatctgtgctacatgcggtggtggtggtggcggtggcggggtataagttttgatgcgacccatcaagtttctaaaaccagaatcaataacattaccaacagatattaaatcagaaagagagttagaccttttgaaatccggtataaatgactcctctgtcgctagaggaagtttcacttgttcactgatagactccaaatgcggaagttttaattcatcagtgtgttggcaatatgttattatatccttagttgtcaacgagtcaatgaaagatatcgcggcttcaaaattcgtagtgacatataattctttctctttcaaccttcgatggaatctgaaaagcttgatgaactggaggttcaaaaacaattcttttcgaggatttgttatcaagagatatatcatcgaaggaagtatctcatcagcgttattttgatcaagagccaatagcttatcatgcaatactattaggcaatgtaccttgtcgcaaggggatacattctcatgtaacatcttatcaaataataaccctaccatatcaagtctttctttatgtttcaactctaacgctaaaaatgctggtaaatcaagtattcgcgaactgcttaactctttcatcgtgttcaatttagtattcaacatcttatcaaactcaataaactccggattattacgaaataggcttgtcattttccattcattcgaactagtcgatttcgcctgtcttgttggatgatttgggacacaagtgccaacttgcagtattttcttgaatatttcgcattcacacaaatccataatctggtccgttttgatattattagcctcttgcagcttaatttgatgggatatttcttctggagtcaacaattgctgataattctgttcagaattagttctagttcttgttcttatgctgctatttcgaaaactactacttctggatctgttgaagatactactcaatccactatttctcgtttctctcgcgttgagcataacattcacacttccaggcgaggctaatgcattaaaatgttgttggcaagatctatcaaatctctcataaaacctttggaatatctgagataattgtgtaatcattaaaggcctggaatatttaggctgtttcaaatcatcaatgaacaaatcaatcaatttcatcaattcatcaggtatactagcaatgggaatcaaatcatcattggattctgaagattctattggtagttctggtgatggaggtgccgatgtgctggcagtttgaagcatgacattcggtttctttgcatcgctattattggaaatcgtcgaattcaaactatcgcgataagattcagtgatggattgtttagtatcgaaagaagcattagaaaatgggggagtatggaacatagctcaattgccatacatgagcaggtccaaagatgattcacaagcttgcagtgatagaaatcataaactttttcttataacgttgttgaagtaaaccaagttgctgtgaactaaatgtttcagtatgaaaaagacattcgaaacccttaattatgaagaagatcaaatacatatctcttagaagaaacaaaagaaaaaaagcatattaaaggcaatattgaaggctcgatcaagagatatctaacaagaaaaagataaccagtacctgtagtatcagcttcatctacgaaactttcttaacgggtgaatttacaaacatttctaatgatcttcattttaagcttccagaaagttctcggttggccataagataaattaggacaaacgaaacaacacctacaaaagtagcagcgaacagatcatctgcttagaatagttcactgcgaatgagcaaggtattagctatacaatgtcatcaggcttcaagatgaagaggtcaaggagtcctgacccgataggaatcgataactataagaaacaacggctaatatatgatttcgaaaacctatcgttggctcctaggggaaccgatgggataaagaaacataaaattgattcagggttgaactcattcaaagcagttgtaaataaaaggatgtgggatgtagttgaacgcgaattgagtggttcaaacaaaaatgataagatatatgaaagaatattcgatcatgtacgacagtttaactcgcaggtaataaaatggtatgactggcgatctgtggtagcaagcttgtgggtaaaatggtaccaacagcatagtccaaaattagatgaagtagatatgaatgttgagactgcagcagattccagagttgatctggcaccgaatctcatgcatagaaatgatgagtttgatcacaatgcggacatggacattgacatggatctcgatacagatccgtacgcggatgcagacatggacatagagctggatgaatagtccttagacatgtttgtgaagtattattatcattttgatagaagtattaacacctatagagagagtatgtaaacaactgatttttacttgttgaactgaattaatgtgaaagaatataagagtgttaatgtcaaaattatgttgaagtattacaatgcgatgtacagtacatcattatgataagcatgaaagccatcagtggatagaaattgaattttgaccaccttggggttctttttgtattatttattatgacgataaaattttgcaacaaataacttagctgtcatcgacaaagatcttgcgtttctcttgaattagaaccggtacttctgcatcagtagtgacttgagtgccaatatcatctccgtttttgatgtacaacttaaaagaatctgcgtcaattctaggtgctattttactgcacaattcttcaaaagtaatggtaggatgcagcatcaaggcgaatatgtcatctttgtaataaaatttgatcttgacaggcttttcatcagttattctcggagcgaaaccactaggcggccttgatttgactttagcactggcattggaagcgctattaatcagagacagtctcttcattgcctctggaagttgtagttcttggttagtcagagttgaatcatcagccctaccttttacgtcaagctccacagtttcatcattactaatctcacggtcaaaaccattatttttaacggcaaacaaacccttgaccagatgtgattgtgatatatgcggcggtagggaaatcaaatccttcacgtatatatttaggtcatcttttctcttttttgaaatggtatctgtcacatacggaactggacccggtatatatggcattatacgtttcgtccactgaccattagtgtctcttagtttacccccttctgcagggaagatatcgagtagctttacttgtaaatcatagaaatcttcataataacgcttcaaaatacgcgtggtgttgttggataactgacacgagacttggaaccaatacttatcgtcctgtaggaaaaatgtctcgactgcagcgtaggtaaggaaaacggcatcagcaggataggttgtattggcagcgctcgagtgctgcgtgctggggtgtggttgacggttttgtgaattttgcctggattgtgatcggtgttgcacgtacgactgaccctgctgttccactgaacctagtgtgatattgctagccttgtaacgggcgatattgatcttccattcttggaccgagggtagattcactgattcgatatcgctttttacatcatttcccgtggcataaccagtagctatatctataatagtcacaaaaccaacaggaactagaccgggaccacccaacctgccaatgggcttagcgataaaccattcaaaatcgtgatgagcacaaatgaacaagttttctccggcataggctgttaactcatctgccttttctgcttgaaaatcatacagtacaattgcataaagagttcccatattggaaggttgttgttgctgctgttgctgctgttgctgctgatgatgctgtaataactgattactaccgacagatccatttctatttatacttttcaccggtgatgcatgcgaatttggccttgttctgccaaaaatctcgaaataattcttaggaaccatgcctctcttgccgtccgccggattggaggcctcataccaatcgttctcctcttgctgaacatggaaaaagtctcccttattgaatgataattcaccggctgattgtgcctggtaattgtataacgctttgattactttttctggagacgagatatcttttgattttccacttgtaaaccccgaagatagctgtgatgatgtagataattgcctgataggaatggtctttacgttttgcactgagctccctggactttgagtaggtccggaaatatccgcagaagttatgcgctgtttcacactgtctttcttcaatttgaaattctattccaaaaatttccagaaattagataattggttcaatttaatcaccaaccaatgatcatagtatatgttagtattttgccttcacgttgcaatattcatgtggttaccttctttcagtaaagaaaaattttccagcctctaacaaagtcagaaatcctccgctactacgtcaaaattgccaaacataagacaataccacgcgcattattacataccttcaacattttcccactattgactgcctttgcctttgtgttgcagctttcgtctatcaactctgttattatgaattcctgaaactcgtctctttattcatgtcaatcctttttcatctcgcttcatcaacccgcagaaggaaaggaagaatttcattctagaagggttttagaggtcacatgatctgaaatttaaagatcgtacagtatatgtatataaggttaacgtaaaagtgctaaaactaattaatcgagtaatacatggcctgtggtcatcataaatcgatgagttaattgacaaaggatgaatgattcggagcggtgaggtgccgcttgtgcaatttagtaaaatatgtctatgtttctattttttcttattcttttggttgttgttatgttggttccagtatttgcttactgaccaggttagactactggtaccctctcatagtacaacatataaacgaatttagtttctgataaaatatctgaagttttatattctttaactttagtatcagatattctccaccatgggtatttcaccacacttttcaatttctttaatcttcttttctttgtcttcttgttgacattcattgaaataccgtcataatctgtttcagtttccacttcggtagcacttgtattagtaacttgatctgtactgtaagagtcgatactagcattactagataatatcgaagcgttgcggtcagtcgtcatagaagagacactgttaaatcttgcgcggtttctatgttctgaagatgatgaagccatgggtgaactgctaatttcaggtagtatattgctagtattgttattatccggtgctgccgagacagaactctttctcgaaaggaaaccagtgactcttttcaaagtggatggcgtccttgaaactccagaaccactgttgttgttttggcccttattatctgcgtcgttagagaactctgagcttccaataacgtaatcatcatcagtaacaatcgcagagtttggtgagtccaggaaaacagatctgaatggcacgttagaggagattgaatcttccgagccgattgaacaagaatcggatttgttagaggagttcagaacggcctgattccagatttcagctgcaagtttattcgacgcaataccgaagtccaccattggtgtcttgctaatgacttgatgtgtatcaatgtctttcataaactctggtttgtgtctgaaacattcatagtgaccggtagaatgagaaccttgatgcctcaacatcgaccttaacttatatgaatcctttctgatgccaacacatttattgttttcaataacttggcggttgactaccaattcttcttcgaaagaaacattgcaggtgttcttttgatatcccatcccgtcgaaaaccgaacgcgacaagtgaagaatcaaaacatctggcgaatcaacaaccacagttttcttgacaatggtggatttgatttctgacgtcttgataccacctttctcgtaagagttaatgtaagtacttaagttcctagccaaatcatcgttaataaatgctttgggcaataactcttccaactccttcaaaatctggttttcttcatcagaattgttttggtaatttctattcttttcatttgcgataatcgcgttcaacttacaacataaacacgaatacccgctgatttgatctgtttgattatcagaaatcatttgagccaaatccgcgtttattagctgtggtactggtaaagaatacatcgtgaactcatgaatgtttacttttgaagattcaccacagcttaaacagaataaactatcagccagcgatccgtgtaccgggaaagtcggtatgatgacattcaacgagtgattcttgacaaatttttgtagagccaagttttcgttctccaacgtctgcaaaacaacttgtgtcaattcatgagcgtcattttggccggtagaaatcttggccttaaaaataccctctatcactcttaaaaagggccaaatagaaatatgatgctgtgcagttaccgtttgctgcaactggtacagtatttgagccaaggactcatgaagagggatcttagggatatcctttgaagatgactctacttcatcggcctcatcggtactctcaccctcactatggtcctctgactggtcagttgatacttcttcttccgattcgtctgattcctctccagtcaaggaggattcctccgacaaaccaccttttggagtcatggcatcttgaaaccgtaaagtacaaaccgtattagtactggtatgtgctttccacaagttaggtctctttgcagttgacaagtcttccgtaacttcttcctgcaatggaacaccatttgcactatcttcatcactagattgtttctgccccccagaactggacccattcccattaatgtccatcaatgtggttaagaattgagcctgctttaatatatcattgaggtactttgtcaaatatacaagtgatgaaagcgcttgtatggaagagttggcaaaacagtcattacgattgttaattaaccccgtagtgaacttatcgcttctcttgctactggaactaaacatcttttctccaaaaatccagctagtaaccgtgggtcctaaaacataaacagttatcgctactgctaatcctaatccaacgtacttagaagttcccttattacgatgcaaccaattacttacccactgactattcccgttatttaagccgttgccagtatagtaaacaactctttgcattcaaataaagccccgaaagagaaacagaagcacttaatagatatagcaattaaaataaacttcttgtactcgaacagcaattcccactctgaattgttattgaacacactttgtattctgatgacaaaacctgagtggggttacaaacattctttcactagaaaaggtaatgtcttttccttaaactataaaaattcgttattgatttctactaccagagaaatgaaaaatgaaaaatgaaaaattgttcctggggcatagaagaatacataaaaatgctcaatgacgctattggcaccggaataagaagaattaaatctggggaaacgacgatgtcaaaaactctgcgatagatcttcaattaagtgcttccgtatgtgagcgcccactgctcgaacctaagtagtgattgtgtcgagacacttcttttcactcttgtcattgcgctttcgaaatcctgtaaagtaacgcctcgaactaactcgaggtttgcatttattagtgtttccccgaggtctcttatgggttccattgctgcatccttcgccaaagacgttagatcagagcccgaatacccttctgtaagtctggcgatttcgttgaagtctgattctgtgagttggtttctttgtactgccatgagtcttttcaaatggtaatgccttgtttcgtagtcgggtaatgggatgtatattctctttgagaatcttcttctggcagcttcgtcaaggtcccagggtgtgtttgttgctgcaaggactagtactctggagctgtccatctgttcttcggatttttcagatgcggtagcgctggttaacgatgaccacctaatcaaaaattctgttttaattcttcttgaggactcgttctcgttatcgcttcttgtcgtaagcaaagagtctatctcatcgacgaagatgatagaaggagctagtttcttggataggtagaaaagtgcacgtacaagtttctcggattcacccaaaaattttgaaagtactgaggatgcactgatactaaagaacgttgatttggattccgttgccacagccttggcaatcatagtcttaccagtaccaggtggtccgaagagcaatattcctgatacaggttccctcaaaccttggaaaagatcaggtctcaagaaaggatacacgacagtttccttcaacgcgcttttcgttgtgttaagccctgagatgtcatcccaatatactttctcatcagcgatcaatatatcattaatgatgtgcaggcatgaattctcgtcaacaccttctaaattatccatgatatgtgccaatttcttttcaagtggtgtcagggctttttcagacttttccagtgataaatcttgtccaccttttctatcaacagacgtggatctactgtgagggaccgacctcgagacaggtgacctgattctttctctatcaatgatcggtgtctcaaatgcaacctcaacgggaattcttggagatgttcttacaggactcttaataacaggtctccgtacagtaggcttcgtatacacaaatgtctgtttagcttttggttttgattgtgctactttttggctggattgtccactccaagccaacaaggctgcctgattgacatttggggaggaggcactcacagttctcacctcattctgatatgactttcgtcttccaaatccatccaggcttcttctaccgaacgtctcagccttcctagtcaattgatccattgatcttcttgtaggcggcatcattgtttcatgcacatttctttcagcggtatcggtggacttcagtttggttttccttagctcttcctgaacgtcttttcttacctgcttctctatctcttgttccttcttcttcagcagtcttgcttctttgtccttctcttctcgttgaattctatctctttcttgtttcaatttctcaacttgttccttttctttcaacgccctttcttgatcctgtttgacgttactcttgatgaatttcatcttcaatttcgatcgccagtctggatctcgcttatcttgtgacttgctctctaactctgcgcacatgtctttgatctcttggcctaaaattctaacatcggcatattttgtaaccacattagggtccttcaaatcaccataatgcaccacattgaacttcttctttatcgatatcaaaccctcacgaagatatgatagaatggaacataatatatcaacagtttcctctttgctacccttcgctttctgttctttgcagttatctaattgaatactgacgatagagtgcaacaatgataacgcctgggttagactaacattgtttgggacaataaagtggtcgtgtggcatcgctcacggtatgtcagccttatttagtctttaatggtgctgattctctatacaattgacttcgccagaccctctttatctgttgttccctttaacaacgacaaagttgacgatttgctcttattttcctatgttggaaggtttcaattttgaagcgatattttggtggaaaataagggaattagtccaaacttataagaacaacaccgggaaagggataataatatactagaagcccgccaaactacgagaattcacacctctaaagctcatatgcagatacgaattcctgtcagaggtaggaccttcttaaacccatgtaagaataaaaatttggaattatatacctctatattataatacaaccgagtctgttttcagatctcatgtttatcaatcactcattgtcatcttgcgagtaattatcatccctattttcttttgaggacaatgtcttacgtttgcagtatttgaccttttcttcctcattcatggtaacaagtgaccagtctttgaagttatcatatatacatatttctttgccccatctagtgtagtttctgaaatataaagaaagtgaattcaaagttaggccgttttcttccctgaaagtttctaaatctttcacaatatgttttctaacagcgtctctgtcctttagtagaggactgttgagattaaacctcttcaaattaatacttctgtcagtttcagtttcgatatagtcgatgatgatacgtctcgttggaaagaaatgagagtcctctgttaccttccaccttctatacccgtatttctcaatcaattccttgatggacagtttgccgtttaggccatgataccattcgttgtataaatcccagattgttttattatcgcgagagagcttgtatttgatgtccatattaggatttcctgttcttttccctttgctattattccttgtcattaccttaggttcattttctgaatcgtttccgttacggagctcatccttttcattgctacccaatgaattaatcttcgatgtagtctgagcatttgacctaacatttgacgcattttccacatggttcaatgagcttgaaggttcaacgtttacgttacgttgaccaccatcagatatactgttgccattgttattcaattcaataggttctgaaatatatggcaaaggtgacattgccatcgggttcggaggaggggatgcaactgagttgttcaacatagaaacagtgatttttggagacgggattggcttcgagagcaatgcttccaatggagaaccgatttgtaatggggattggggttgtggttgagataatcttcttgaagagctatcaaagttcgacatatccttcccatccagtttcattctcttgatagaattcataggttggttatatatgtgtctcttatcattcatcatcttagaatagttgacggagtatgcaatatttggatttgtatttgaggttggaatcatagtattattgctggtattaatcattgtattggaattcacattattgttttcattattcgtcacattgtttgttgagttcatagcctggctgttaaaattagccatggtactcgttatattgttagcaggattatgtatctggtacgataacagttgtctctgtgtatggaaaatttgattgaccacggcagtcatcgatgccatttgggacttcattgtgcgcaactcatttgacaatttatcgttctctgttaccaaatcctttgagagctttgtgaatctatcctcaattttaccacacacagaattgaagcagtccatctgaagtagttcattatctatttgacgttgcatttcatctttgaacaagttccaatcgtctgattcaaggaactgccaacttagttctgatttaatcaattcttgtaaatgcggtagttgtcctgtacactgcaagaaggcaaaatcttgtagaactattttcgctagaaagtagaataactctacgatggagaaaagaatatagttagatctgtcgtggtttaagtaatccctctcaagagctggcaaccagggaaacacaaaactaagcatctcttttttcggcgtcacagtggaccgtatcatgttactggtgtatacgggtagccgaagttggttgttcccttgtaacatgattatatcttttgaatcaaagataagcggcaaattcatgaagtttttccatgaaatcgctgtctgcttccaagtgatgaaagaatacaacgcaattgcgaatacgggacaactagtgatagatttatccctatttattgtattgaaaaacttgtaatgcgagttctctgtttgcatgtttcttaacgtcaaggtttgtgggaaagtagaatcctgggtcaaatctagcaacctaagattggccaattcgtccttattacatttgaagaattctatacacacaaatttcatcaacgtccccaaattaagccgagagttcattagaaagttagataattctgatgccgaagcattgtcgacagactgaagttgcgtttttgtcggatcgcttttctgttgtacaacagaagatccgttcgctgtatcatccataccattgaaaattgtcggcgttgaagattgagctcgattcagctgagctgccaacatcggatcattcaaccaatcctgtaaattgatattcaaattatccttatccatcacgaaaatccaaataacaaataacaaacaatgaaaatgtaaaccaaacttaaaccggattaattttcccctaacgtggaatttaaaatgtcaaacgaaatcaccaaccgttaatcgaacttcctttatatgattgttaaaggtaaaagcggaagtgacaacacgaaccgaaacaagaaaaaaaaagtggtatccttaagtcaattgtacagaaaacctggggcaaacactcctttgactcgagcacaacgtcccacccgttccctggaaacgcgaagggaaggattacctaatggttctgaaacagtaagaaagcttcaaaactcagaatggtttcaaactaaaagctgattccagcttccggaaagatatcaaaagggaaagaaaacagagaaaagaaaaaaggacggcgataattggtttgccaaacttgtttagatcaaatcttccactggaatgcctcgtccaatgtctttctcaccgctgactctgtatcttcctggttgcctttgttcaccgaaattgaataagcaggaaaaaataccctgatttctgcactagaaacaaacgcttttttggcaaatctaaatcgacgtacaataggaaagattatcctactcacagacctactgattcactcacgcagtgactcaacggcgtatggcttttctatagaagaagcagctggcgttttagaacggtttgctagtgtatctgatgggccttgcgatgagatggagcaacgtttgacgatggaaagacaagtatcagaactgagaagaaggcgaattcctttaattttccaactttcgtgcttgaattcttgttttttttcccaacttcaccgtttcattgctgttcaacttcgtctcctgacattagtggaaccccaatgggattatttttacatgaaccgggtaacgaaatagtaaaataagggcaacgtgacttataatttctgttatattacagacgcggcacgcattacctccaattgccacgtcaaatgaaggtacccccgtagtatgtacattggtaactggcatcccgcaaaataagcatcccttctttggaagttgaaaaacacgaatccagatccaattactggactcctacccctggatggaaaaacgaaaaggaagtcatttgtggggggtatggctttggcatcgtgaaatagggatcttcatttacccacccaaggccactgcaaaattcccgaccctttaaagcctctccccactgtttctctgtacacatatattttatactgggttctctagatatgtagcttaactgcgttctgcgagtaaaaattaaaataaagttcgaatcgaagtctaaaaacgtgctgtggactccggggctgttcaacctgttacccggagatgtactgaaaagataattcttgaatccgtaaaacgtgacctttaattcagatctctaaatgccagttactttgtgtctgagagtagtttccaggttgaaagttgaatatggaaaaaaataaaactgaaaaatgtgaatgaataagtaaacaaataaacagcaaatgattgctaaatcattgccttagcaagcttgaactataccagtacttgagcttaggagtaagctgaataaggaactaggtatacttgcttagccttttaaaaaaaaaaagcgtgaaagagaagaacctcttagcacagtttccggcttgcttaatatgtcttcgaacggcaaacaacagggaaacaaggcaggcgatgcagctgggggagcgtcaggagccacggctcccggtgcaggcggaagtagtggcaatggaaatagtagtgcggccggaaatgctagcgctaatgccaatgctggcggtagcggtgccagtgggaatgcaccggcagcttctaaaccggggttttcagcgtcagatttgaaccgcatcgttttggaatatttgaataagaaggggtatcacagaacggaacagatgcttcgtgctgaatcgtcacgtactttgacgcctccaaataaaaacgctgctgcttctaacacaatccctgcctcgtctgcatcagccactgcgattacaggaagtactaccactgcaaaacctgtttcaaatccttcgatgcccttgaaaagagataacaacggccaattgataaaaccgcaacaggtgacacccttgcactattttagagcttactcaatgttgaaaaattggatcgattcgtctttagaattgtacaaacctgagctatcacgtatcatatacccgattttcatttacgtttttttacagttggtcatcaaggaccccttacaagcgagaagattctttgacaagtattctgtcgattacaaagcccttcatggatcagaaattaaccgattattcagtgtcaactcagtagatcacatcaaggaaaatgagttggctcaaggtttccaaaccaataaatataagatcacaatctcaagaactactttgaaccttttgttgtatttcttgaacgaaaacgaaagtgtgggaggatctttgttgatttccatcataaaccaaaacttggatccaaatatcgtagatgttgtcaaatctgaggatattctcaccgacgggatcaaagatatctcaaccggtgatattgatgttgatacgtataactcggtacctgtgaagttaggaccgtatccaaaggacgaagagttcaccaaggaagtagagattgagttgcagaaaaaagatgaacaagaggcagctgagaataaggataaacctgtcggtaagacattagttgaggaatatagagaaatgaacggtaatcagaacaaaccagagggcactgaaaaagctgatgataacaccgttaaggaagaaaatgaaaataaggaacctgaagctgaagagggtggagaagaagtcgatgcaacagcagatacagaagagaaaggcactcctacacttagtgtcgaatcatcggctgctgaaagaaagaaaagagactcaaagaataaagacgaggaagaaaaaccagaggcttcaattggatctatgatggaatcaccagcaaaggattcgttgccgctaccggtaaaaacaactttagatctaaagatggaaattcaaaaagtaagggagagtagagattccatccaattgaaaaacctacaaacttctgcaccaagtgtgtgtatgtacactttccacaacactaatggtaatatgacttgcgtagaatttagtgatgatgctagactaactgcagctggtttccaagacagtacaattaaggtatggtaccttgatggatcaccgctacagtcgatcctcccatccaaagctaaagaccaatcgaactctgctactttggtaggacacagcggaccagtttattccgttgcattcagcccggataacaggtacttacttagcgcatctgaagataaaactgtcagactttggtctttagatacgttcacttgcctagtgtgttacaaaggccataaccatccagtatggtacgtcaagttttctccacttggccattatttcatcaccgcttcacatgatcaaacggctagactatggtcttgtgatcatatctatccgttgagaattttctcaggtcatctaaatgacgtggattgtagcactttccatccaaatggttgctatgttttcactggttccagcgacaaaacgtgccgtatgtgggatattcaaacaggtgattctgttagactgtttttgggacatacatcaccagtcaccgcacttgaagtatcgcctgacggtaggtggttaactacgggcagtgaggatggcacaattatcgtatgggatattggtactggtaaaagaatcaaacagatgaagggtcacggtaagaatcctatctattccataacttttaacaaagaaggtaactgtctagtaacaggtggtgcggatcaaagtgttagagtttgggatataaagaggtttacaaacgagcctggaatggagccggaacaacaattcaacacgtattcaggagatatggaactcagtgtaaataacgatatcaaagaattcggacgtaggcgggcagtaataccaactcaggatttgatggcttcgttccatacaaagaaaacagcaattcacaaagtaaaattcacaagaacgaacctagttttggctggtggtgcatttattgagtaaatgcgattactttactcagccagataagggtcgtttattcgacatatctagtagttgtccaattgtaataaataaaaaaaaagagaatgcgctttatctttatattatttacaatgagtacgtatattttatgtgcattgatatcaatgcagtcaatgaaatgtaaatgttaacagaatcctaataactaatctaatattggtttttcagcgtcccactgctgtaaaatcggatgtcctttataatagtagctttcccagtggatatagtaatgagggattccaaataatagtaacaaagatgatattcccaaaggtatcgtgatcccgacacccattaacttcgttataaaatagtagactgtaccatgtgtcgcaataacacatagtatatgcaggaatttcaacttattctttatgaaatacttttccatcgtcggcagtagaatgttaatttggatacatatcaaaaggaaacagaaaacttgggtggaggtatctaatcttgaagaaagtacggtcacatttgagagtagaatattggtcggtaggattttagattcaagagcggagatcgatatgatgtaaaaggttgtgaaccatgcagatagagtccagatggaatcggacgaagttgtcttggacaaagatttaagcactggagataaggtcaacattgcaaatataatgatgatagtggatttccagggtaccctcttgttggcaactattaaggaaacagatgaaattgaggcagcaattaaaatcggattgtatttgtaatgatagaaccaggcaaatataatatagagtaacatagtattaataatcatgtggtaaaactggaagagatcaagtaaaacagacctgtacgaggagtgaggcctcaaatgcccatgttcaattttcaacttctcccattgtttgtagaaacttggatcagtgtaggtatctgggaacggctgtttcaaccacaataaccgtttccattgtttccccgcagccattaacaactataagagaagacaatttgttattcgggaaacgactagcacaatatagtcactacagtctggacaaaagaaacctggagatttgccgctatactcgcgataaatctctgcgagtgcaggaagttacttcagttcaacagtcgtcgctagctttttcgaatcattaaaattagagattgatacgtaaaaaagctaatccattacaacttaatatcacagcacagccagcgggagcacccgcacaagtaagatacaaaggatatagcctaacttactgctcaactcattgctacatatacccaatggatcaatctagcagggagacatcaaattcgtttgatcaggtaaccaggcaatcttcaaacaatgaacgaagacctacggattctaaagccataccgagaactttacccaaggataccgttccagacgacgtacatgctacaccaaaagtggatgacaaggataggatatggacagatatagatacactagatgatgtgaaaagaatggccagagagggcaatactggccttactttcccggataatttcgaagaggatattacccgcttacgccagatgcatgcgaacttgatgcagcacatgaagagacaatcaacagagaccccaggaaatcttgaagaacaacagaaacacatcaatgatatcgtagataccattgagagatataactgaataaatacttcaaatcacgtgatgaatcacgtgccacaattaccctgactttttgttgagtattagtggaagctaaggtttccaaggaccaccggtttcttctacgtgcctttcactatttgtttactggatggtgcgaaacaaataaaaaaagcggaagctgacagaaattacaagttgttccgaataacgatgggatatacgaattgatgattgaacgtagtatggaaaataataggaacgttgagaaaaaaaaggatttggtattttccatcacctgcgaatttgagggaaatggttaacttaaatcgtggattctttatatatatatattctctggtgaaggttcttgatcaattgcttcttccaattggtatttcgattgtattcttgagtcacgtagaaaggaatttgtgattagggtttaatcgctgaattctgaagtgaccttttaactgaccgtaaagtacaataaaaggttttaaagttctgttaagatagattctaaaacagaaataaaaagacaaatatcagaaatggcttctaagaacacttactctgacttcaagttggcaactgaattgccagcctggaaccaattgcaatctttgtacgaacaaaagggtaaaaagctaaatgttaaggacgagtttgctaaggacaattctcgttatgaaaagtttgccaagacgtttgtcaattacgatggttcaaagatcttgtttgatttttccaagaacttagttgacgatgaaatcttgaagtctttgatccaattggctaaggaagctaaggtcacctcattgagagatgccatgttcaacggtgaaccaatcaacttcactgaaggacgtgctgtgtaccacgttgccttgagaaacagaagtttgaagccaatgtacgttgatggtaccaacgtcactccagaggttgacgctgtgttgcaacacatgaaggagttcaccgaagaagtcagatctggtgcttggaagggttacaccggtaagtctattaccgatgttgtcaacattggtatcggtggttcagatttgggtccagttatggtgactgaagcattgaaacattatgctaccaacttgaaggtacactttgtttctaacattgacggtactcatattgctgaaactttgaaggatttggaccatgaaaccactttgttcttgatcgcatccaagactttcaccactgctgagactatcactaacgcaactagtgctaagaactggttcttatctaagaacggtggtgaccaatcccatatctccaagcattttgctgctttgtccactaacgctactgaagttgaaaagttcggtatcgacacaaagaacatgttcggttttgaaaactgggtcggtggtcgttactctgtttggtccgctattggtttgtcagttgctctatacatcggtttcgacaactttgaagcattcttgaagggtgctgaggcagtagacaagcatttcgttgaaactccattggaagacaacattccattgttgggtggtctattatctgtttggtacaacaacttcttcgatgctcaaacacatttggttgcgccattcgatcaatacttgcacagattcccagcttatttgcaacaattgtctatggaatccaacggtaagtccgtcaccagaggtaatgtttttgcaaactactctactggttctatcttgttcggtgaaccagctaccaatgctcaacattctttcttccaattgattcaccaaggtaccaaattgattccatctgatttcatcttggcagcccaatctcataacccaattgaaaacaacctacatcaaaaaatgctagcatctaacttcttcgctcaagctgaggcattgatggtcggtaaagatgaagaacaggtcaaatcagaaggtgccactggtggtctagtacctcacaaggtcttctctggtaacagaccaaccacttccatcttggctcaaaagattactccagctacccttggtgctttgattgcttactacgaacacgttacattcaccgaaggtgctatctggaacatcaactcatttgaccaatggggtgttgaattaggtaaggttttggctaaggttattggtagtgaattggccactgataacaagatttcttctcacgacagttccaccaacggtttgatcaaccaatttaaagaatggatctaatgtgagaatgcgatgcaatttccttttcacctaagatatgcagtgaacttagaattccacatctttacgtacaaccaaactaaataaacttctttatcaaaacgctatgtgcaatgaatgacttatatacgacaatgtcacgaatatcaactacattggaagtaattgttttcacttaatcaatctcttttttcatatttacattaaggaaaatgaaaaatgatacacgtccaaaagattcaacaacgcgtgatgtagtgcgagagtacagacatcgagattgtgacaagatataacaataccaagctagctcatagcatatagaggacgcaacaatgagtgagttgattatagaagaacctccagaactgggctctggaatttctaatgaagtacagcaaaggtataccaattggaagaagaatacaaagttgctctacgactatttgaatacaaacacatcgaaatggccatctctatcctgccaattcttcccagaccgtactcttacgaatgacaaacaaaggatattattatcttcattcacatcgcagcaacttccgcaggatgagtcaatttacatcgggtccatatctaccatgaatcatatgaaatggagttccatcaataacttcgacatggatgaaatggaatttaaactggataattcattgaaactgaacgacaagacattagaagaagaggtacgaataacgtaccctgacggtgattgcaacagatgtcggtacatgcctcagaaccccgatataattgggactgcatcatcaaatggatcagtgtacatatttgatagaacgaaacatggtaataagatttccacaggcaggaaattcgaaatcgaatgcagaaataacggtgacgatgaacaggacgagagtttatcccttgcatggaattaccaattggagggtaccttagctacatgtcaaagtaacgggaaagtaaaagtatgggatcttactaaatttgataagtcgaaacagagaatggaaatacctgaaagagagagtgtgatggacgcgaatggagtcaatgatgtgtcatggatggtaaaccacacttccattttagcatcatgcggagaatccaacgtcattggactgatagacataagacaagatacgaaaatggacacattacaccgtactacacatacagatggaatcaatgccatcgagtttaactataagaacgatatgatattgtgtaccggtgattctcagggccagttaaagatctgggacataagagatttcaaggagccaataaaggaatgggaacatggagatcaggatcccatctctgccattcaatggaaccctcagataccgcaaatactggccactgcagatcaacagagtggattagtgaagatatgggatgcatcaggtgaacaagaggactctaacgctgaaaacaacatgctattatttgtccatggtggtcacatgctcggagtcaacgacatttcatggtcacaacatgatccatggaccatgtgcagtgtatcgaacgacaattcaattcatatctggaagccagcagcaaacttagtagaacaattgtagattaaactggaacatgtcgtcgatatatacatgtatcggtattgtttattcgcatataataaatgtgtcgcacgacacaagaaacacgttactcttccttgaattcctttcacgtgacctataaccaatcatagcactgaacatggaccaaatcaccgggtacgagatgccactctttacaactctctacaactctctacaactcttctatgcaaacaggtatacaaaggatatgccaatctaccatgtttcaactctatactagttgcacaagatacgccatcagcaactgttgtatgttttatagttgtatactactttatgccaatactttccactacgtatagcccattttttattttccagcagccaggccaattcgagggaaaacaaaattttctctttcaacttttggcgaaacttttaggatttggaaatacctacacttttcacacatcgaaatccaattaactgacctttaattagttagaagttatagacatacgtttgtgttattcttgaattgtagttcattttgagttttatttcgactagctgattgactgccctttcatttagatccttatctacttttaatttgccgttccagtttcaccaaagagctttaggagaaaggtgcgaacttgagttaaattgattgacaaacagaaccgaaaaggagatccaaaactgatatatcaaatatgttccgtgctttgactttgaaggcttccgctagaccagttgttgccggcttgtgctctcgccaagccccaattgctgctgttcgttacatgtctaccccatcaccacaagatccaaaggccaaggcttcttcaatcttggatgctttgccaggtaacactgctttgtccaagactggtatcttggccaccagtgctgccgctgccgtgtatgctatctctaaccaattgtacgttttgaacgaagaaaccatcttggttgctactttcaccggtgttgtgttggctggtatcaagttcttggctccagcttacaacgaattcgctgaaaacagagttaagcaagtcagcagcatcttgaactcctccagaaccaagcatgttgatgctgtcaaggaaagaatcgaatccgtttctgaattgaagaacgtttctgatactaccaaggttttgttcgatgtttccaaggaaactgtcaagttagaagctgaagctttcgaattgaagcaacaagttgacttggctgctgaagccaagtctgtattggactcatgggtcagatacgaagcctctgttcgtcaattacaacaacaacaaatcgctgactccgttgtcgccaaggttcaaagtgaattgggtaaccctaagttccaagaaaaggtcttgcaacaatccgttgctgacgtggaaaagttgttggctaacttgaaataagtttgatttacatattgtctctccctgttttagaagagcaccgtgtttttcttaacttcttttcaatatatttacaacaaccaaactaaaaaccacaacgtacaatgactttttgaataatgttagccgcaaattaagaaataaaagaccactttacatttgtcatgtcttttcgatacttttgacatgattataatggcttttttgaaggcaattgctggctctatgcgtgcttcatattcaaactaatgggcccctttatgaaactagatattccaaagatttaaacaaaaaaataactgcaataaaaatacacttttacaataaatttaacatcaaatctacagatcaatatcaacattgtcatcatcaaaccacaatcacattattatccctttttctcttcttcattatataagatttgagctattgctttcatgtcaacatcaaccatcttttcataaccttatatagaagaatggctcgcgaacttacgacaaaagaatgactatattaaatttaacttgacaaaggtaatctcgtattctatttaaacataatcgaacccttacgatgatttttggtcctggtcttttatgttaggtttcggtagtggtatttcttttagtccgtttaatctaggctctatcggtgtgtctcgcctaaaagttcttggattataaggaatattttttaacccaaatggcgccttaccggagggattccaatctggatcataaaagatgcttttaatacctagctcggcactcatcggtttcttaatgtcttcttttcgtacatcagacaaatcttcattttctatgttcttacgcttaagttgagatacttgttgctgtaatgagtgctctatagtttaatgttagtaactgatgatgcaaaataaaatctaaataatgacacatactatccatttcagttgtatgaatactggtaatacttgacggaggttttttactagttctttttttgcttgactttatcaacttggtgctggttttacaaagacttcataagttattttaaggttttcttcatgaaaatatcagaatcataatgactatgtttaatgatgaagtggtatatgatatctgaatttcgtggccaactatacggataccgccgactaacaatgaccgatactccttcgaacacagacccactacaatctgcaattgctcctgatttcagcagcgtccctactcaagcacttgacgcgcttcgaatgaagttttctcagcttactgcatcattgtccaagattagagatgaaatgtccagggcagaacttccgcaatggtatactctacaagcgcagttaacggtgactctatcacagctctcatcacttacaaatactttagaccactatgaggagactttggatgcgacagtagcttacccactaccttcatttccaactactgcccatgaaggattaatcactacgttgatgagaaaaaagaatatacctgaagtcgatgaatggataaaagatgccaaggagactaacggtttagatgtggactctttgagcgatgcagaaattaaaaagttgatcaataaagataaagacataacctcttgggcaacgaaatgtctactcgatgaaagagcaaaacattcatatactgggttgtacaccacaaaggagcgtcaaactgaatcgattgatgacagagataacctgtatacgtcttctgtttctaatgtaaagacttcaagacctttcagcgttgataaagtcctcaaatttgtcaatcagggagaatcatactaatcaacctttcaattaatgcaaaaactggttgttcgattgatattatatatagtgcaactaagtattatatggacatgattttatttacaagatcgggaatgacaaaatatggttacatatagaaggatttttccatgcaaagtgtgttattagagattagggccctttgaacaggccaatcttgagttatggttgccaacggtacaccggggttcatctgttaaacgaaataatagaggagggagaggatcaagatagtaatttaattaccagttcccatgttccaaacatgataatactgttaggaacagttcttaacaaatgaggcgtcaaaccactatacattgaaacgaggccttcttccttaatgatgaccctaaatgactgtactaatccggtgtacttcaatttaccattctctgttggggcctgtcttaatcttgttctaacaacttcatgggggtaagtgacgatactggctacaaatttggctaaaccagcacttcccgacctttgacaccattctttaactttgtcactagtacttttagcgtcctcatgaatatggccgaatttttcaatagacctttcttttataattctcttcatttgctcgtacaaaatccattgaagaataccttcaactgagcctagatatgaggcactcaaacctttgtaaagaccgagaacaccctcatttttgacaacgctcttaatacagtccagcgaattcttatacgtttttgttcctgctttatcaagctgtaatctagttttaacgagccaaataggatttgtaacggtggatgtagcccaaccagcggtggctgccgctaacaaatgaatccaaggagcttcctggccattattaagtgttctggaatatatatccttggtagtaccgtacgttaaaaagttgatacttctagcaggaatgacaccaactaaattaggtcctaaacctttgaacaaacttctgaatccttcctgtctataaacgttaccgataataccaaaagtttctttgaaatgcagcaaactccttgacacaaaatggagagtgctgcttccattattttgcatggccgcagatttgtattgcgttcggaaaacatcactttgtaaacgggtcttaacaacatcaaacgggcaagtgacaatggctccagccataccgccaataccaccagctacaaaatgaacccagggtttcactgctggctggctatcatcttttatcgttgggagacttattctatcggcacttttcaaattagctgccttctcatcactacctaaaaatggagttgactcgatggcatctgattctaatttatcaaaatcgttctttcccattgtagtatcttcaaataacacttactgggtcgatgtaattctcttgaaatgatggaattatctcactttgaacaaacacaatccaaatcactgcttttcacctcagcagttaagaaaaaagggattgaaatgcaacgaattgacctggtccccaaagtaaaacagaataacggtgctattttcagcagatacctgtataatcgttttatataactgaactagaagctcttggcctgtgtcttcccctgattgtagggaacctgtaatgtttccgtcagatgatattcctttgatatgatgagatgagctttcaaaattttaacattcgcagaattacttttttactaatgttccctgcaacagcagcaatcggctggataagttgtctgacaccatacaaaattagaaacgtaaggcaaataatttacatgaaagtttttattgtgagaacagatattatttttgattgaatagatattcactattatattatatctttaacgagcaattccaataatatatatagaagttataaacaaaaactttgcaaaccatgataatttgagaagattagatgaaagtttcgtatggaactggagccaaagtttgagggacgttaccttcggtagaaacgacacgggattcctttggttgagctggttgtctctttaattggacggcaacaccttgagccttagcttcggccttcttggcagcgttagacttaactctttccaaaaattcttgtctacacttggagtgcttgatgtgttcaactctcaagttcaatctcttttccaagtatctgttaccaaccatcttgttgatgatgataccaacggaagacttggtgacgttgtagacaacaccggtcttaccttggtagaacttgtgtggcatacccttgtggatagaaccgttagccttgatgtcaacaatgtcaccaaccttgtaaaccttcatgtaggtagacaaggcgatggcaccgtgctttctaaagtcacgttggaacatgtaacgagtacgagatctgtaaccgtgtctgttttaatattaaaatgcgaaattttaacttgttagtaaaatggattcttattacacattgcattccctagcgagggtgtgcttatcttcaatccagtgagtataatgtcaaaaaagttcgtaagatgattgctcattacaggtctgattgttatgaatatctttataagcctcttcagataaaaagatcacttaaagatttcgttaccagtagatagtatattccatcatagtcctatggagttttgattctcatgccttccataaacaaagtatcgttcctaatccttgttccttgtcacatcagacgtagtatcacacctgaatttccctgatgtccaattctgtacaatgagactcttaaccacgttagattagtccttagcaaggctgcttcactttactgtttcgacgtctagtcattttaaccactatgcttgttgatgatctactgatatccacgcatatccattctatcttcaatcttcaattctttatgacatttacttggaaaaacttttgaatgttgctaccacatacgatttacccatttttgcttattgatccttggttgttgacggggtcttgtgcttgattcaaagaggtattgtgtatactatcattaaagactttttgttttctatacactctatgaaacatgcctataccgcagaactcacgaacacagcatgcagaatcacaaacttcccaatgctgcctctggattgtccagtcaagggtcggtgaaactaggaccggtccagtgtggagagggtagtaggccgtttcccagctcagccagtgagaatgctctgcctagcagctggtagtggttattgggattgtgttcccgagctagacagagaggagaattaccaagccaatggtggggaaagaccttcagaattggcggccccagggtggggccagtgtggtacccagcgaaagcaagttgcaggaattgtggaatgcgtccacgatcaaacaatattgaactcacaactttcaaagaaaaattccattttaggttaactagttaaaataaaatttcaagaaaaagccatggcaccaaaaggccgatgggtgtacggatggatggacagtccgcatatagaggaaggtatgtaatgtcgtaatgcttcttgtcgaaatgacggaatgagttgaaagagatgtctttcgacgttttttaagcaatgtaccgtgaaaggtaaactggtatatattttgttatggtttctcaacgagccaagacaacttgaacgtagttaaaatgatctcactgtaagaaaaccattaattaattatcgtaatatacaccttaaaataccgtttttgtaaaacagagataaatgatattaaatgaaactgctacactagttttgtttctgttttctgcttaaatcaatcacatgagaaagatgttaattctatatacacaacacagcagtgaatagttgggatcagcttcttaaccatcataaaaactctgaaatgaagttgaaaagaaaaagaagtaaaggcaaaatgatcaaaagctaatataaaaaagtgatgctgaaacattagttgttttcagcaattgtagttttttgtgtagtttttgaatgcgtttattcttcgtcagcttcttcaccaccagcagcagcagctctctttctggccactctacctggtctagcaccaccgaatggagaggttctagcgaagtcaatgtgcttctcagattccaatctgaccatgaaagatgggatgttgacgatttgcttaccaacagcaatgtgtctttgggagatcaagactctagcgtggtgaacagacttggccaaacccaacttgtagacttgggtttgcaatcttctttccaagaaatcttcaaccttcaaagccaagacataatccaacttcttcttgtcttcagacaagacaccaattctcaccaatcttctgatcaaagcattaccttcgaacaatctctttgggtccttttcgtctctggtcaacaaatctctggcggctcttctgatcttagacaattggaaagaaattctgtaaatttctctcttgttcttcaaaccgtattcaccagccaacttcaattcggcgtccaaacgagcggattcgtaaggtctctttggagtagagtaagtcttggagtaagttcttggggctcctgtttggataataatttcttgttagtgaaaatattcaaaataattgtaaaactcacgtgcacatatgtactcgttgtccccaatatatctgatactaaaatccaaagatcactgcactacgaggatatacaaacgggcgatataatatctactcatgaaacattaaactattgacacatcaaacatttaagaacatgaaaacacatgaacaaaaaagaagtataactgaaaaaaacgaagtccattctgtgggtcaattgacaacagaatgaggtgttaattcatacagtactaaataagagctctcgctcttattgatttgcattaaaatgtttctatccttgagctgaagtgtcgggttttcaacgacaaggaacaaatgaaacagtttagattgcaaatcgaatatcagtacttgaaatactttgagtcaataatttaattgaatcatgaggacccgatcctcgaaggaagatttaagctagctgatgctggcattatcttccccatctctagacaatccaaaggaaagacttgaaatgtaacagagtgtatcaatgaagcatatctggaatgtgataccacatacttggcattgtaactcgatgattcttgtgttcttttgttcatgtagaaatgtgttagtctgttaaagtgacaatgcctttttatactcgttcggtattctgacattgaatttttcaaaaatttcagagttcgtactatgtcgaatactgaaagcatcctcatttccaaatcaggaaattagtcctatagttgaaaatacaatggtgtacgggcgataacagtcctgtcaccaaaccataacctggtgtcctagaaagtagttatgaagtggacgggaggctaggtgttgacggaatgcaagagctcatcacacacttggtttggtcagtttggaattaaaaaggttgcaagagtagataatgcaaaagtatggaatcattctgctaaatatgtatgaataagataaaaatgttaaaatactttggtgtcagcaataccgacttactgactatcgttattttactgaactgaagcagcttgttgtcaccgttgtgaatgcctatgtttaagtagaaagaaccctttatagttcagaatggtagtccttgatgatagtatcgacatcttcgatacttagttgcctgacatcacctatctgtttaatcttagatgttacttccttaatttggtcatcggataaatgcaaatttagttgttcgacacgagacttgattgcgttccaaccagttaatctgttggcaaagtgaatatatctcttcataccgaaatcttctggatttagaatttcgtacgtagatgggttagccaagatggccttggcatgaataccagccttatgtgtgaatgcacagaatccagtgatagggttgttaaatggcacattaacactgacagcatctgcgactagattttccaaatcacgtagcttgtgtagcttatatttggacttgacgtattctggggcagatacaatcattcttgccattagaccaccaagagaggtgataccgtttctttcaccaatacccaacacggagacatcgattaatctggcgccggcttctaacgcagaatatgagttaccgatagcacaaccagtatcatcatggaaatgacattcgatatcacaagaaactacactcttcaatgttctgactagctcatatacttgtcttgggtttgcgcaaccaacggtgtcagcaataccgactctgttgacaccgatcttatccacagtcttgtaaatgttcaaaagatcaacaatatctgatctgaaagaatcttcagaggaaaatctgatctctagacccttggatttaacgaattcgataacttcgatagctgatttcgctatgtagttcatatctttaccatgagaatattctctcaaaaatttggaagtaccgatgacgacatcgacaccgtcaacaccagtttcaacagcgactctagcatcatccatatgacaacgaatatgcgtcaaaatcttagccttcaagcccagcttacagattgcttcacaatcgcttctagattgttcagaggccaccggagaggtaagttcgatataatcgacaccgaaatcatctaaagccttggcgatttcgattttcttctcagtagagaaaaatgcacttgcaaattgctcaccttctcttagggttgattcgattagctggaagttgcaaacatttgataataaatcatttggagatggggcatatggattcgaatttacggacatcttggatcaatcaatagttttgacttggtggtattttcctaatgcctatctatgactgaagacaaacacacgatatactatatctctgagaaacgttcaagacctacacaaatatgcgtttatatatatataccaattccaacataggtgtggattgaccttatttccaacctggtcatcgcatctaactctcagaaggccagtggtgtatactttttttttcatcaacactgctttacactgcataagagtcattattctcgccaatggattcctaattaggctcagaaacgcatgcagagaatttgtccaagattaaatagaaacacgtacaaactaaacatcatcgattcgatgaataattactaccaaagaacactacgctttgccattcacgacgatatcgccacagacacacctgtgaatttccagcggaaattctagttaaaaatccgggtgacgcatgatgcttctagtttttcagtgagaaaaaaatttttccagcggaaaacaaagcaatcggtaagaaaagaaagaacaagtaaagaaaagatagtgaacattacccggataaacataaatgttcagtgcgggttcgaatggccgcacatatttttatcgataaaaagtagctcattagttacttacgtaaccaacggtgtataagaagaggatgtacgggtgtacataattaattgcttccctccttttgctagcacatctttatttttttttgtttttttgtcttcactgttcattattctcaaattactggtaattttgcacgactttccacccatgccattggtcgggtgcgatatttttactgagaactttttctttctgtttatttttttttcattttttttcgttctcaagctcactatgggcggttaactaaactaaaccccatcacctagtacagagaaaacatagggttgaccctttgtatataaacgccaaacttttttcgcaagtttttttttttttcggggggcctgcgtttcaggatggaagttaaactgaaagtttccctaaaaaaacctgttttgcgggtaacatattctttgtttttttttgtttttttttgtttttttttcttgtttatttgtacagttctgcctgttggctgtgttcaagcagcagtttgtttaagttttttttgattttttcattaccctagttatttctcgccgatatttctttttcactgtcttgagatttctgcatatataaaagaaggtttatattttggcgttatttgttttggtctcagcggcagaataaacaaattggaaaatatcaacaagggcgcgagaactacatcccgaaaaaagacgcctacatatacggtaacgtgccagagggaacgtcacgatagtgatacatacgtgtatatatacagagctctcgtctatcgcattgtttcccttttattttcatttttgtttttgaattatattgcaagtgattagcatgtcatcacaggagtctcgattagacagacaggttatcttgttagaaactgggtccacgcaagtggtacggaatatggctgctgaccaattaggagatttagccaaacaacatccagaacaaacactcccattgttatcgcgggtttacccttatctattgagtaaacagtgggaaactagagtgacagctgctagagcagttggaggaatagtgtcacatgcaccgctgtgggatcccaatgcggatgacgaggaaagtaaaaatccccagacgcagcagccattgggtccagagtctgccaaagttaaaattgaagaggagatgaaggtaaaattggaggaattgtcacatacagatgaatggaatgaactgcaggacgacacgcattattttactttgaacagttggaagattagtgagctgctgaagtctgggaagagtctactagcagccagtgcaaatgattatgaatcgaaagctcttaatatcaataataatgggtctgcagatatcgaacaggatgacgctaacaatgtcaaacatctgaagaaagaggattcgtttgccgatctgaaaaaggaaaatagtacggattcgcttgcagatgaggatacggtaaatgaaacgaaagaatcgaagagatcagcaagaatgctggccatggcaagaagaaagaaaaagattcaagctaaaacggtaaacaaaaaacctgtagatttgtcacagtctagtgccacacgtaatatgatacccaataaagaggatctgagtgattctccaactccggtaccaatgactttaacgaaccctaaacttgaaatcacagaacaatccgatgagaagagattaatggtcgaatcaatggtgcaacctatcttggaaaaacatgaaaagattagggggttcgtctggcaattccaaggaatttatgaactcctattagataatcttatgaacgaacagtgggaaataagacacggtgcagcattaggtttacgtgaacttatgaagaagcatgctccctcagttggaagactaagtggtaagtccaaacaagacaacgattctcgtaattactgtagcttggaagacttagctactcgtctcctaacaatttttgcattggatagattcagcgattttgttaacgataccgccgtggcaccggtcagagaatctgcggcccaaacactcgcaacattattgatacatttagacgacgaaattgcattgaaagttttccaaaagttggagcaattggtacttcaggatcctggacttacaggatctccaaacaaaatatggcaagctacccatggtggattgttgggtattagatactttgtatcgatcaagacggatttcttgttcaaacacaacttacttaacaatgtggtaaacatcgttctttacggactcaaagaaagcgacgatgacgtacaaagtgtctctgctgctatactttcaccaataacagatgattttgtaaagttacaaactgacaccattgatttagtgctaactacagtatggaactcgttgacacatttggatgatgatttatcatcaagtgtctcttcagtaatggatcttttggcaaaactatgcaaacatgaacaagtactcgctgtattaaagcaaaaaagtatcgactcaccatctgaatggtccttcaaatcccttgttcctcaactatatcccttcttgagacattctatcacaatggtacgaaagtccgttctcaatttactatcagctttcttgtctcttaacgacagtgccaccaaaaattggataaacggcaaactgttcaaattgatataccagaacattttattggaacaaaatgtggaagtgttggatctatcttgtaaactttatgccgcaatgttaaacggttacgttaatagcaaaggacaggaaaaaagcattgattttgtattcagcaaatatctcacatcaattttgcatttattaataacaccaatcggagagcaaggaaaaaattatgcaatggacattcagcatattaccaaaccatcttcgagttatttgataaaccttgagcgtaagcgctctaatgccacagctaacagcagcaatgtaaccgccacttatagccatcgcgtgaatattgattcaccaatgttggctggtgacgtgacattaattgggctagacataatatacaatacaagagtaaaggctgcgaaaactttgggtttaaccttatcgtttttccaagaatccacccttagatctttctttgagaatgtcttagcaagttgtcttgatttaccatactctaccccaagaatgttggtagctatagttctatcatcgttttgcacgaattggaaagagaatcaacagcataatccggtacccgctttcatgtctacactatttagctctactttcctagggtttttgacgggcgcgactacacttccagtttttcgtgaactaacaccaattttaaaagcattacgcactcagtgtcagagtttgatgacaacatttgtcgatgtaggaatgttgcctcctcaaagagttcccgcaatcgcgattatagttaagggcgagccagaagctggtcccgaggccttttcaatccaaactgccgagaaagtacagacagagttttatgccaaattgttctcactcctaccaaatgctcagaagattttggctcaaaaaccgttagaagacgcacgctatcgcgtttccttggccatagaatcggcaaaagagtcagaaagggaaaggcaactagaggttttgtcaagttacgcgtctgcagttatgttgatagatggtttaccaaacaagttgaatcctttaattcgttctttgatggacaacgttaaatctgaaaaacataccattttacaacaaacatcaggggatagcattgttaatttaatcagtgaattagtatccgctcagaaacacaacgttgcgaataagattgttaaaaatttgtgtggatttatatgcgttgatacatcagaagtccctgagttcgatggtaccaacacaactgtcataactactttagtaaaagaggcagctagtttgtcattacaagaagactctgaaatgaaaaagatgaccgagtctgctcgaatcaagcgaaaaggtggtatgcatactttgatgaaacttttgattaaattccaagaaaaaaccttggaggtagttccacaattgaaaaagtctctattcgaaccacttgaaaagattgatatcttatcttctaacggagatgaaactactttcaaaaagactggccaagaaatcgtggacgccttcggaatcattagggccttgttcacatacatgccagaaagtgttcaagatgaggaagtgctttctagacttcctgttttcagagatttcttgagatcaaatgtttcggtaatacgatactcagcagccagaactttatcagaactagcatgtcataagcctgtagtccttatgtcatatgtcattactgatattctacctatgctcaacaatgctggctccgtcacagacaggcaaggtgttgttgaactattgtaccacctttctattcaattggaaagtgacattttaccttacgtcgttttcttgattgttccgctattagggaggatgagtgactctaatgaagatattcgtaagttagcaactactaccttcgcctcgatcatcaaattagtgccattggaagctggtattgcagcccctgttggtttatccgaggagctattaagaggtagagaaaaagaaagagatttcattcagcaaatgatggatccatccaaagccaaaccatttaaacttccagtggcgatcaaggcaactttgaggaaatatcaacaagatggtgtcaattggttagcattcttaaacaagtatcatttgcatggtattttatgtgatgacatgggtttaggtaagactttacaaacaatttgcatcattgctagtgaccaatatttgagatcagaagactacaaaaagacacagtcggaaaaaacacgtccccttccatccttaatcatttgccctccttctttgacaggacattgggaacaagaatttcaacagtactcacctacactaaatgttctcgtttatgcaggtggaccttcggtaagatatcctttacagggacaagttccaacagctgatatcgttgttacttcatatgatgttgctagaaatgacgtggactttctcaaaaaatatgactataattactgtgtattagatgaaggtcatatcattaagaattctcaatcaaaattggcaaaggcagtgaagctaatcaattccaatcatagattagttttgacgggtactcctatccagaataatgtagttgaattatggtcattatttgactttttgatgcctggcttcttaggtacagaaaagatgttccaagaaagatttgcaaaaccaattgccagttcgagaaatagtaaaacatcgtcaaaggaacaggaagctggtgctttggcattagaagctttgcataaacaggtactaccattcatgctcagaagattgaaggaagaagtgttgtctgatcttccaccaaagatcattcaagattattactgtgaactaagtgatttgcagaaacaattgtacaatgacttcgtcaagaaacagaagaacgtggtagaaaaagacatcgaaaatactgctgaagtcgaaaataaacaacatattttccaggctctccaatatatgagaaagctatgtaaccatccgtcattggttttgaattcttcgcatcctcaattccaacaagttcaaagctacctttctcagactggaatggatctccacgacataggacacgctcctaaattagaagctctaaagactttgttactagaatgtggtattggcatccaggacgttgaaaagaagtccaacaaaaatccctccattgataacgtcattagtcaacatcgtgttttaattttctgtcagttaaaggatatgttagacatggtagaaaacgatttgttaaaaaagcacttaccgtcagtaacttttatgcgtttagatggtagcgtcgactccagagatagacaaaaggtggttcgtaagttcaacgaggatccatctatcgattgtctactattaaccactaaagtcggtgggttagggttgaatctaactggtgcagatactgtcatttttgtcgaacacgattggaacccaatgaatgatctacaggcaatggaccgtgcacatagattgggtcaaaagaaagtcgtcaatgtctatagaataatcactaagggcactttggaagagaaaatcatgggtctacaaaaattcaaaatgaatattgcatctaccatcgtcaatcaacaaaatgcaggcttaggatcaatgaacacacatcaattgttagacttgttcgatgctgacaatatcccttcacaagagaaggttgagaagaaaaaaactgttgaagacgtcgctaacgagagcggcttaacaggtaaagccaaggaagccgttggtgaactaaaagaattatgggattcttctcaatacgaagaagaatacaacttagacaactttataaagactttacgatagatatttagtattcagttctgcatatgtaatgtataaacttacttctagttttaccatttggcaagtcttcgcattcttatatcaacccaattatatgcatatccttcgattttttgcatttttggattcaaaaaggaaataaagaaatcagtgaaatgcgaagggaaccaacaaactgcagataatttcaattcgaatacataatacagaaatagcactgttgctttataaaatatcatttcttaagcgaccaactataacattatacacgataatcaaattatggaatcagtgattgaagagaggaaaaaacgtttacttcagctacgacaacaatacacggaagagaaacaggaaacagacagtttaactgtaaataaagaaaagaagaacattgagggaatacaggatattccagccgaaggcgtatcaagcgaagaaagactcgatagggacttagaagaactcaaaaaaagaactgatcactcaattaaactattgctaagagaaaggatattgaaagaggctattgaagagcctgcagttaataatgatgaatcttaatctaaataaataaaatactcatgataatggcgagcataatagccacacattatcatgtggttacagatactctaaagtatgacatagtaacggtagaaaataaaatggaatctataaatctgaaaagcagttaattaagaaaggcttcgtagacataaaggaagccaaagataaagaaggaaagtgcccctcccaatgtcacagttctcatactaattttggatgctaatagcttaccgccgataactgcgacaccggtacaaatagcatggccaatgcacgctcctagcatcacatatgtgaaattactacctgaggccatggctatagtagagatttgggaacgatcaccaaactctccgagaaaaaccattgtaaatatttgaatccaagttccagaaatatatcttgacgtgaagtctttaaatttggtgaaaaccccgtttgttttttctttggcgtatttgttgctatccttaacggtaccttcctcagattcatgtagagtgtgatttatatcttgaattgcaatttcttcttcaacttctgctagctcttcttcaatgcctgcgttcttaggcatctctaacccttctaagacaagtttgtaaccgaatactaggaacaaaattccagcagcaaataaagtatacttgtatgggatcaaagttgtaaaggtacggccgattagaccacctaatatagtcattatcaccaatgatgctgtagatgcactaaaaaccaaaagcctatcatgacgcatagccattaatgcagctataagaaatgttttgtccccaatttcagatacacctatcatggaaatagctagaaggaaagccgttaccggttcttcagatgaaccataatcttggttgttttcatcaactggttcaattgctgtcactgcacaaagaaacagagcaaagcttaaaatcgttctcacactagatctcatatcctgcttgtcctgtgctatggcttaattttaagagcttatcttctttcttcagtgaaggtcgttttcatccgctgccgttttcctaaccgtgcatttacatagatatttatatatattaactatgtttatccatgatcaggttagtgatgacactagcttttttttttttcttttcgtatgcgtgagtgctgcactcaattgtaattaggaaaatcacgattcccgcaataaagtggcttgggtctggaccattttaacttctcaaacgtccttcggaggcatttaaaatgaaatataaacattgatttgatgatgagcacatattagggtggtgttgttatgaagggccaaaacagaccgactttttcttagtcggaaatacaaagagggaaggccgaaaagggtttggcccatggagaagagagctgcaaggatgtgcatcacggtttgggcacttttcgaggtcttagttcatacatttccttcgttcagtttcaaccttttttttaagggtcttatgagaaatgctcggtgggcgtattaagttgacggtgatgttttctaagagtggcatttagtgcaagaaggtattgtgtcagtggaataggtacatccgtgaagttttctgataggcagctcaaaggtacctttgaaagggttcttccacttatcttacaagcctattcaaaataataccaattaaggggagtaaaatgttagtacatccgttcagtgctcttttgttccagtgggaacatattgttggaaggtacgacacatacattggagaaaactgccaatttctttatgatagtttccatttcaaattcgttctcatccggaaatatgatttcagaattaatcatttcttgcgttatatttgttaggatttgctggcacaccgttacagaagggaatcccacataaaaagagacgtctagcctatctaaaaacgctggatctatattttctctcaaatttgacgtgcataataagatgaagttgggatacttttttagattatctaaatgcgtcatcaagcagttgagaacccgtacagaatctgtcgtctcgtttgtattcaacaattgatgccttgaaatagctaaggattccacctcgtcgaatagtaaacaaacgaattttttggacgcttgttcatgctttaatagccgttctatatcgttaaagataccatccaaatttttggttgactcgccgaaccaccttgaaaatatttgagaacacgacacttccacaaggattccagaatggccactatcgaacaaattacaattccgtaaagcaagtttttggcaaaatgatttgcataatgtagtcttaccagttcccggcggtccatgtaacaagaataagttattcttacggattttcgttttacatttttctaataggtggcttagcttgagcgatgaaataccatgcgagtacatcttttcctttaaattggagtcataatgaagcatttcccattgtttgtcaaatttaactgaaggtaataatgttaccttcacttctttcaaatgttttagcgtaaggggcaatctagtatgtacagtttcgaataatgtactatcactgttattgcctgaatcagataagccaatgttatcaaattcttgacttatacatgaatcaaggtttccctgtttatcttcaatattgatatagaaattcatttcatacgacaggctcttcattctgcattgctctgataattttaaatctttgagaaactttgtttgctcactttccctattcgatagaatcccgtctatcatatcttttaaaccctttccatccttcagctctagcaaagcgcctactggactattctcgattatctctaaatcaacatctttgacgtaagaagatagaattgtctcttcctcgaattgcgtcacactcggcaatcttatgatagtgtccttaggtccaggaaccatgtgcttttccaatagctggtgccaaactactttaagaaatgcttttgggaagtccgtcccatggttgttcactcgtagaagatccaaatcttgtacgatcgatgatcttaatttcttggtaatttccaagagcgattgaccatcagaactatgataacctatcttttctttcaatttagcttccaatgcattctggattaccattataaagcttcttgcaactgctttcgatccatcttcttcatctattagatcttctaaccatccaatgcactctgcgttcatttcacaatcaacaaagatccttaccattccgattagtgagtgggttccataagctcgttgtgtctgtttctgagttattgaacgaagaccatttactgtaaatctttctactatattatatatttttacattaactcttttttatataacttgtaaaatggagttaaaaggaaatttagccgctgatgccttcgctaaaatatttaactgctcaattagccttctcagtatgtagatgtgacagcaagataaaatactcttttgatacgttgtgactttctaccgttcttcgcaatgcctgcagaagtttaatatctctttgccttggtttgttaaggtatgatgaacagacaagtaattttaattttgtcgaaaagaatgaaaaatataataattttcaaaacacgaacaaaacaagtaatgttggagatttcccagcgcatcgaatttcccaatagggaaattatcaaagcagcattttcatgccactgaatcgctaatccatctaggtgaatgatttctaacgacagatttaggtaatccactgataaagaatgagagtattatattcctttcatttttctttaggaatcacaaagcgactgattattggcaaccccatatcttttaggcatctccccttcgtgctgatctgtaaattgaaggtttatcaacacctgtgtatatataagaactgagtcggtgcatatttcattcatttcccttgcaatgttgtagcgaagcagtcgttctgaaaatacttgtgtttaataacatcaaacaataattaagataaagcaataaccaatgagttgttgttcgaaaaaggttgctgacagcggcgctgtcaaaagttgttgtaccacaagatcaagtacagccaaagctgttaaagaaagtgcttcttcttgttgtggggcagcaggcaacagcggtaagccgactagatgtaaatgcggtacaggctgtgcttgtgctggttgcaacaacgtcaaattatgaaatgggtatattttactgtgtttcctcttttcatctcgtatcgatattatcatcgctgaaagcgaaggtagacaatattcatatttgaattcctaattacataccaaactttataccttttaatctataacgaagaattccatatcaatttcgagaaaaagtttcactgaacggcacattgacagcgagatgctcctcgtgagaacctgagaagttgtgatgggttttaaccagcctttatgcaattgcctgtcaatataaaaatggtatcaccaaccatccttatactgtctcatggtatgctcgcatattgttggaactagtcataattcatgaccgggtaataccaatataataggcggttaataatagttttgtgtcactgacacataacaaagtatataaaccagtactcagatctaatctactaattagtaggaatcagatctacagacaccaggtgcatctaattattctaggagatatatagctaatcaagatggattcttctaataaagatctgataagatcaaagccacgtgacatgtatagtcacataacacaacttatataacaggaggagatgaccggcacttatccaagtgtccgatatagtgtaacggctatcacatcacgctttcaccgtggagaccggggttcgactccccgtatcggagtgtttcattttttccactttttaattagattttcaacatatatcaaatcgctcactgtgatgagatgaggaaatacgatgttcagtactactaacaacaacttcacagaaattttgtgacttacgcggacaacggccagttatcaatcaattcaatatacggtacagacgtgtagctgctctttttttccattactagtgtgggtgaaaccgtttgttttgttacaacaaggagcatcaaaatcacaagatagtctggcatgtccgacaatgaagaaacgttcaatgattcagatgtggaaggggatgaattgcttcaagattggtcgctagcaactaaaattattggtgataataagaatgtgataccactgcgaggtgaaaaagattacgagccagatggtactggtatgcaaggatcgatgcttttcaaggctaagaaagtgatgtttgatgttcttcgacaacctgacaggggaactatcattaagaatcaagttaaggcatattatgatcttgatttacatgttgcaactattaagtttccaaaaggtacttttaccaataccgttggtagtcctaattcggacggaaccttaaccttgcagtttcatgaatttgtgtacttagtcgaaagaggaagtgtttcaccaattattgatttgggtattaacggtgaaaaggaagagtacttattgtcattgcaagatgtctattctttcttcaaatctcaagatgaactggatgagttctttgtgtatgcctatttgaaaagaatgggctatatcgtgtttccaaccaactggaaatatggaaaacaactttcagtttatagcagatacaacaaaggggaaaatagattccagaatacataccttcttttgaacggaatttttaacctatttacaaacatctcctattcatggcttaaagactgggcaactaatatcaacaacatcataagtttccacccagtgaagtttgcatcgtctggcgcaatatttgagtccattaacaagacaattaccttctacgctcctcctaaatctcaaaaacaactcctagaaagtcatggggtggatcttaacgctcccgtgtcgtcaaattataagattgcatttgatgtatggaaacctaatccatcttttaagaagagtaacagatatctgcctgatttccaaatagtcatccataataaaaactccaagaaagcggaatttccaaacctcaaagattttaagggcatatttcaacgattagatcataaattcccttttattaatgatgttgatatagccgaagaaaaagtgacaaaatcaaacaagaccggtaatgttgatgctcagaggcatttaaaaagcagacgtaagaataataaaggagataaaaccttgagcttatatgctcggaaaatgaagagaattaaggaaggttatcggagtttccttttagcggtgatggatggcggcttggtgagtatagtcaaaatcacagaaacggattttggatctgaaaatatatggtatgttccatcacctaaaatagtacagtggaaaaaaccaaaccagaagaagagaaattagcattagcattaaattcaagatatatataaccacaaacactatttactgaatttggaatagagattttcatcaaagacagatggattgttataaaaggatgtcggtccattctgcagcttttgatcgctgacaagcccactgataccggtagaaagaggtttcggtggtaattgaggcggacctggattcactccggtgttattagtgttagcgagatttgcaggactttgagttaccgagtcattaacatcattgcataagtttaaatttgcgaaactctttgtaagtgttgtagattgtgtagatttttgtggtaagttaggtggcaatgtgttggaatctatcaagtttacagattgtccaggggtggatgcgtggcttaattctctagtcatcttgagcaaagtgtcgtaaaagtttaaacccttcggcaaatcggtactaaatataacgaattggttaaaagccttttcaaccttatcgaaaaaggtctgtctttctttcactgtattttcttgttcaggggtcttatcttgtactccaataagtttgaaaacttcgtccaacttgatttttatgtcgttaatcaaattgttttgtttgaatattgttgcttcaatcctagtactcaacggtttgaatttagtaagctcttcctcgaagataaccctcatttcctttttcggcttacctgtcagcaatatcaacttttgagttatatcatcattgttcaagctttctttgaaatcttttaaatttcttgtacgttcttcttttagtagtcgtagaatctcctgattgtgtttgatattatgaaggcgatctaagatctgttggttttttgagtcatcgagatcaagtaagcttggttcatcattccttatctgaaatttactcattatgctccacaataactgatggtttgctaacaaattaacttcctccaagcatggattgatagatgcaaatattttgtcatcagattgagatgcctgcactaaagagttcttgattttcaaggcattttccctttgatcaggagagacagaggataaaattgtaagaatctcatttcttttgtcaagaatattttgcatttgcgctcttacatctttgaaattactgtcttgcacaacttttgaccaagtagttattttttgcttcattatttcatattgagggtcatctgatgaaccatttccaccgtgtacatatcttgattcaaggtctttgataagtttcggtaagtcagtaaattcaatgaatgattgatattcccagtctgctgtatccgtctcctcgacctcctttcttaacaatgaagctttttcctcagaatagatactctcattttcatagacttccataggcactatacctttaaaggcaccattacagagatctacaacctgctctaggtataccttgagctgttcttcccaggtcactggctttacggcgtccatggttttgatgctttctatgctcacatcagctggtatcaaatcgttataaatgaaatcgttgtccttaattaaacttttcaacttctcttctattactgcttttaaccctgttagatcaatctcatccttcacatataccttatagaaaccagcctcttttatttcatgtaccgcaagcttaccataagctatcgcctctccaattttcttagcttcctctagcactctcaagtgattgtatgtcgaaatagccctatacaagtgaacctttagggtaattatatccttccatttgtcttctccataaggcgtagtcccaaaagttgctgttgaactatcctcataaaattcttgacatttctcatacaaatttaaggcagtatgtgctagtttgctgatcaaagatgctcttttcgaagcatctggtccattaatcaacgtcatgagaaacatttcctgagcttcggcgtgcaacaatgtggagagaaaagatgtattttctgctgcacaatcgatagaaggtgaattcaaaaagttgttcgacatataatcgaagcaagccattgccttgctcaaataaggaatcgcgctcttataattatcagacatttttttcttagcgatttgagacaatagaacaccgatgttgtacatgacagatgatttctcaaagactacagtatgttgcttgaattttttttctgacaacctagagtgatattctgcttcataccacgtgaaatccatctgtaatgaaccgctgtgtgcgcctaaccttagatagatttgctccaatatagcggcgtacttatagttctgatctaataatgattctggcgcaagatctgaattagcagtggtcctacacgaatcaatctctgccgtcttgtcgccatcataaaacacggaccactggctagatccgtatgaccttttcaaataggttattaacccttttgtccaactaatactctctgtatccttaattttaagtggaagtagaactgttttcattatgaaatgatcgatttaaaagaaataaagagtaggtacttgcaaactgtcttgcaacgcacaaatgttaactctggtgtagtggttctatctttgattgcccaagtgctttatcgttcttggttaagtagtttgtttgtagatggctaggtcgattaatgaaggttagcatcaaaagtatcaaaacgtgcaaaacgatctttaggcgaagctttcgaaaaatttcgatgcacatctgattttaacaacagcagcagattaaaggaatgaaggttgacataaagatgacagcgtttagtagtatctgaaccattcttcgtagttgatcattggaatcatccagagtgctctgagacatcccattctctttaccattaacacccccctgtgaattaaacaaatgtttcaactaagaggaataagaaccgttggacttttagggaagagaggtcgtttctttagcacctctagaaggcttctagattccgatggtgttgttaaaaagcctgccccattcaatccacgtcatatgggggttgcaaaccaggtatatatcgcaccttccaagaaaaatatgcctaatccaataacgtccccagtggcttatttcaatgtcttggtcaggaagatctatacgttaggtatgaacaccattcaagtagccttattccgttatcaatcaggtctcaagccaaattttttactgtggaagaacaaagctatcgaaacatatgttcaagttaatgaagcttttgctaaaagagaactggataccatcaaacctcaagtgtccatatgggttgacgaggctttgacagcgagagccaaacaaatcccatcgaacattaccttggactgggaattgattaaattcaatgaagttccaaagttagtttccacacaagccatgatgattcccggtcgtccagttgaattaattcaattgatttataagtttgataccaaacaaaggttaattaagttcgacaagaagaaaagtaaaactgataaactggacagagatgttattgactatatcgctttcctttgcgatgcaagcacaaatgatattctattaactggttctgtttttgagagtgcaccagacgcgaaattgccaaaagatagcgaaacttcgaaccaaattgtaatcgaaagaatgaaagttaacggagacttgttcagagttcaaccacctgttaaaaaagactgataaaagtatatcttagtaattaaaaggcctcgctttacgatactaccttgtaaataccaatgtaaaagatgatcattaatgactatatttatttattttcagtaaattcatagacgtcgaagtacactaggttcatttaacgctatatgcaatacacttgagaacaatttcgaaattcaattatcggaagaactagttaacaaagtgatgttataaattttccataacattaacgtaacctctagtcgatttctttttccttctcgtcgacgatgcgctgctaacgcctccagtcaatgccattaaatcatctagaccgtttgcttttgacccagataagttgacattagtattcgaaacaggtggtttcgaagatacgggtgattccgactttgtctctgcatcatcggagaagtctttcacaggatcaagcggtttgccggtcaaaggattggtgggcataactgcgtgtgcagtccgtaacgctggacctcccacaactgaaccttgacggggttttatttcaggcgtttttgacatcttacgctttacgacaggaggtggtggaggtggagtcgccactttcaatttctcttcctcagtagcatccttattaacccatcttttcaggttttcgtcatagtaaaagttattcgcgtgtcctagtttggccttaataggttttttctcgttagaatccttcttaaaccagcctaaccaacctcctgatgattcgttcttctgcttcttatcaggtttcccggcttcatcctcgctcacagttttaacttcatcttcatcttcatcatttttcactttctggttttgattttccgagtttctttcggatatttccctttttactgaaataggttcgtcttcatcttcgtcttctgtgtcttcgaccaagtcatcatagtactcttcggtattagtatcactgacaatgaatggtacgaaatttgaggtttgaaccggtctgattacaggatctttgatttttgaagaaggcaatgtttgtgaatcgttctgcaagtgtgccggtaatccaatagatttaacagaaatcaaattttctccgagaccaatattagaaggaacaaaagaatttagaggtggtgaggacgttttgttttcaatttcttgtttctgtccgtttggagaatcaatagtttgcggtttggcatcttcaccggacagtttatagcttccatacgcatacatcgcaagatcttctgggccacctgtctcattaactggagcactattattatcattgttataaggcgaagttgaggtttgaggcagggatgccatagaatgactttccgtaatagaagaaggtgaatacggattgtatgattttcttgcagtgcgtggagcaacaccgaagctattcttaggtgcgtaagggttcgcaggttctgctttgtctacactcatatttttcaaagaagaaggtttagaagaaatagaagaggccggggaaaaagagttgagcggttgagcttgcgtgacgggaacattaatatcggttacttgatttttgtcctcttcttgcaagttttctgcaacaggtaactgattggtgacgtttaactgagaaacagacccttcaacgccagagatcgaattttgttcggtactctcgaaattgttatcgtctgaaaactctgagtgctgtaattcatctaattctgcatcaatttcattcccaatctcttccacaatgtcatcaactaccgaatgttgttcattttcatggaaacgaggtggcgcattactcccagtttgggtagattcagtggttaaacccgaggtgactgtatcatcgaatagattttctaacggtagtgccttattggaagtagatgattgatgcttcgttgattgtggagagactattggggaaggaacgcagaatgaagcagtattttggtttggcacacccatcttactatagagtctgtggccagaagagactgaagaattgccatctgataaatcgtgatggatttgatatccagggtatacttgagctaaaggtggcagtacaggttcaggtgtagagttggaatttggcagttctttttgtccgagagaggttgcaccagagggattaacatagttatcaggctcttcaaagtgtgatggatgtacagtgttacgagcagatgcagtggagttcaaaggttctatattagaatggctgccatagagctccccaattttagactgaggtttcatatcacgtagtggtggtggaccgtatttagaatgagtttctctactaggtaatgatgaggccggtaggattttcgtagttgatttaatgagcgagctgttattggactgtagctgattgatatgtgagcgattcaacgcaggagtcaaataggatgctgcttgtgataaatctgccatggatgggtttctcgaagaagttggtgtaaacttctcaaagaccttgtcttcaattgctgctgtttctgactcatcaatgtctgtgtcacctccgataaacttgttgaaggatttgtcaagctgtccccatacgctgcttaattttggcttccctaaccagcctacattactagacgatagttgattactcaaatcttcaatatagcgtaatgttttcaaggtagtctctgagttcttaggaagtgattttagcatactttgggccatatccatgtattttgttgacgaactgttcaaaccgtagtcacttaaaccagctgcatgaattatcttctgcggtatcaatgacgtgaatccggagaatgatggatctttctgaccgtacgtaaattcgtatatttccgataagatcaaactttcaaatgagtttgggcagcaaatgtattcgaatgttgtagaagaaaacggaatcaaaggctcttcggacattggaatatcggcaacgataaaagcgatggaaccagcaatgacaagacctctgctgaccaaaagctctccgaattgaagcaaaaattccaccacaataggggaaagttttccattcgcaggcacctcctcacaattgtttagaatacatgcaatcaataacttccagttatttagagaccactctagtttcgtgggatcttgtttaaaagaatctatcacctttttagaattgccaatgaaaacctggaaaattgtagccaataaattaatagaagagatgtctcgttcgttgctttgctcaaattcttgtgtcaaatactggtccacaactgacgaccatttttcctttcctaggatactacccaatagtaatgccatagcataatcttttaaagctagagaaagatttaaagcatcgtcatgtgcgcctgtttgcaataacgttaaaactctaatcaaagaattggcatcgagtttgtgagcattcggggcagcaacctttggaatgaacggctgagacaaataaggaagcaatatactggaatcgtaaattatatttgtcacagcttttaaactgtaggatggatccaaacgcagttttaagagctcaagcaaaatacaggtatcattcgcaccctttagtttcttctcttcaatataagtatctagccacttagcaatatctttggattttgattttcccttgattagcggacccggaaactgttcaagagtcttgtcaagagtcaaaatggagtcgttcgaaataacattaattgaatctagtttgggctccaccgccgatatgtaatcttgtgtattcggtattcctaccactacctttgctgattttccccaatggaaaattggaaactgacggcttacaatataagagccattcgcttgaatcgatggattcctcgattgatccattatcggaaaagtagacgcgataggttggtttgtattttgctgggatgcatagccgtagtttgagtccacttggcttcgaggaaaaccaacaggaataccattcaattgctgctgttgctgctgttgctgctgttgctgctgtagtagttgtagttgttgtagttgttgttgctgttggtgttgctgttggtgttgctgttgttgttgctgctggaactgtggatgaacagttggtgcatacttactactatgagcatggtgtgccggagcatatatgctggagtttgagcgggcatgagtttttttgttatttgctgtcgttgacaaagtaggcgagagtactggaggaacgttatggctatcaaatgttgtttgtaaatgatctgttgccgttggagcagcagtactcaaatgctgcggtgggaaactatagatattggattccgtagaaggaacacctggtataggtggaatatgcccagggttgaacgaaccagcactatctgcggacgcatttgtgagtactctatttctccttggttgagccggctggtacggtgtttctttgatagaactggacgccgtagactttagagatggagtgtatggattgtgggcaatggtacccacaggtgaaactattgtattcctaggaggtgcagagaggatgttggcctgtaggttttggcctttggagggaacattattaatgccatatgcaacagaatttggagcaattgttggattgactactgccacattcttcttcggtgcgtacggattgactggtgggtcaatgcttgttctcctggattgagcagcaattggttgtgaaggcaaagcagagctcccgctaaaactgttttgcgaagcaattctaataggtgccgctcttgtgggtttcaattcaggaataggtaattcggcgtaaaagggcttttgtggggcttttgtgttatttggctgcggtcttacagggggttgaatcaaaggcttttcggatgctacactggaaaaagaaggctgccttattgatgggagagggctcgtaatgtgcatcggtttccctctttttatctcctgtttaactaagtctagagggaaatcataagcatcggttctatgcttcgcctcatcaagctttttatgcaattcattcacatctgacacagaagactgtgaagagttggaattattgattaacttcggtttcacgataccaggggccactgaagctgggacagtggaagcaactgggtaagtgtatgaggagggattttgtgggaaactaggtggttgaccagaaacgctgttggagaatgaagatgcctgaggtgaataaggattggattggggatgatacgaatgtttcactgactgtggcactggcgatgatgctgaaggtaggtagctcttctttggggcctgcgcggtttgaggctgtggtacaattacttcttcatcagaatctaataagctctcgtcatcgtccaataaatcatcatcattctccaaaaatgagaatttcgtcgcttcttcagaaggagaaggtatttcttgtgtattgctttgatcattcagccaagaaagcccttcttttgctccgtcatcaccttcgctattgaaaagatcagtatcttcatcacccgttgctttctcaatggcatcattaacaggttgtactggagaagaattctctcctgaaacaagctccgtcggtgtagcttcatgttccataccctgtgtgtcgttatcggaagttaaatagtcattatcatcgtctagaagagcatcaagtgtcaccatgttcggtgcttttctgccgtcattcacctgggataatggctcattaaagttttcaatagtagctacttctctctcggactgatccaattgtactgtattcttttcatcgtgaagtaaaggagggaattgttcttgctgatcgtaatcattaatactttcctgttgtggcagttcccgaccgacctctgcagaaatactgggcaattcttcggctattatctgatcttgccaaggcagtccctccgtttgtaccgtgtcgtcattgccaaataattcttcaacgggatcattaatcacagaaggttgagcttcaactggcatacttcctataactgagtcgggcgctttttcagaagcagtaatctcatttgaaacgtgctgcgcattattaagagtaccgacattcccaacgttagcatcattggtaaatgctgcagcgacaaccggtacatctggagcttgttccttaacaatggaatcgaacactgcagcctcatttgcaatagtgtcattattttcttgttggaacaagtcagataaatcgttgtgctctggtacagcgtctggaatggcttcagtatgaaccaattgcggtgtatctgcttgtgaagcctctgactgcggcgatacttgtgcattaaccgaccttacagagccaattgcctcggcagaagactctaaatgaacatctgtggtctgcggtacaatcgcagattcatctgccgagccattagaagcatgtagccttttctgctttagcttaagcttcttcttctgattcttccttttcttagcgtctgggcccataactgctttaacttcttcttctcaacaagctattacaattcccgatcagaaaaaagaaaatagataaaactggtacacaataagagcaccagtgaatttagtaactggtcgttaacgcctgatttccaagtgctgtagaacgtctattctttgcctttttttctttctgtttccgttctatttacgatgtgatttgttcagtatttattaatctgccgtttgcatattcaaatctttggaatcatactgtaaacacgagagggaaagacagtttattcaaggtcatgtggtacggatatttaattacccggacaattaattttcttaacagcttggccaagatactaaatggctaacggtttactatgacggtaaaagaaaaaaagactgaaattcgataaaaaaaatcatcttccagcgatgagatgtgatgggatgagatgagatgagttttagctgtaactctgagtgggctcggttaacttgtagtgctctgtactttgaatatttggaaacagttggtcggctagtttggttcaactgtgaacagaagtatttcacggaggaaactaggataaatcgataagtaatgggtcgcaaaggtaagggtccaaagaataataaacaaaagctagctccagagaaggaacggttcttgcaatgttgttccgatattactattgagttgatcagttctttaactggtggttccagcaaggaggtcaatttgaatggattgattacaaggtactctaaaaggtacaagttgaagcaacaaccaaggttgacggatattatcaactctattccagatcagcataagaaatatttattacccaagcttaaggctaaacctgtgaggacggcttctggtattgctgttgtggctgttatgtgtaaaccacaccgttgtcctcatattgcatacactggtaacatttgtgtttattgtccaggtggtccagattcagatttcgaatattcgacacagtcgtacacggggtatgaaccaacatctatgcgtgctattcgtgctcgttatgatccatacgaacaagctcgtggtagaatagagcagttgaaacagttgggtcattctatagacaaggttgagtatattatcatgggtggtactttcatgtccttgcctaaggattacagagaagatttcattgtcaaattgcataatgcgttgtccggcttcaatggtaatgatatagatgaagctattcaatactctcaacagtctttgactaaatgtgtcggtatcactatcgaaactagacctgactactgtacacagacccacttggatgatatgttgaaatatggttgtacgagattggaaattggtgttcaatctctatatgaagacgtagccagagataccaatagaggtcatactgttcaatcggtttgcgaaacatttgcggtcgctaaagatgccggttacaagattgtttcacacatgatgcctgatttaccaaatgtggggatggaaagagatatagaacaattcaaagaatactttgaaaatcctgcttttagaacagatgggttgaaaatctatccaactttggtcatcagaggtaccggtctatacgaactttggaaaactggtagatacaagtcgtataacgcgaatgctctcgtggatctagtcgcacgtatcatggcacttgttccaccttggacaagaatttatcgtgtgcaaagagatatccctatgccacttgttacatctggtgtcgataatggtaacctaagggaattagcattagcaagaatgaaggattttggtaccacatcaagagatgtccgtaccagggaagtcggtattcaagaagttcaccataaagttcaacctgatcaagttgaacttattcgaagagattattatgccaatggtggctgggaaactttcctatcttatgaagatccaaaacaagatattttgattggtttattgagattaagaaaggcttcaaagaaatacacatatcgtaaggaatttacttcacaaaggacttctattgtcagagaattgcacgtgtatggttctgttgttccgctacattcaagagatccaaggaagttccaacatcaagggttcggtacgttattaatggaagaggctgaaaagattgctagggaagaacatggatctgaaaagatttctgttatctctggtgttggtgtcagaaactattacgcaaagcttggatatgaactggatggtccgtacatgtctaaaaggctatatcaggagtgttaaatatgaatcacaattttatcaatatttattgttcagaggaggagtttctcgaattattttatgtacgtagatatataatctatttatttgttttgcatttggttctatgtaataacgcattttttatcggttggatcaataaattctggcacttctctcttctgcaacatatggatgctctttgtaatacttcgcgatgtcaataaaggtttgttttaaacgatccaaaccttcttggtcgatattctggtaatggaatgctagtctgccatcccataatctaacattattcttttccgcaaattccaacaagagcttcaatgatatttttgacttagctaaatccacaaatataaaatttgtctcaacaggatgttgtaagaccaattcaaactgatactggtcctttagtgtatggaataaatctgtccaaaacctgctggtagccttgttaacttcaacaatcctgttcgggaagttgagatcaatacagtaattagcaatcttagtgataaacccggcttgtcttataccgccaccttgttgtttctgtatgtgcctagctttcttgatgaattgagacgaccccactaacactgaaccaattggtgctccgatggacttagaaagacagatcgagactgagtccactaattttgacactttttgcatgtattctatttcagtctcaaactccgaagaggaattattagcggcggcggtggcggcggcagcattccacaatcttgctccatcgagatgaattttaatgtcttgggaatgagcccagtcgctgattctttgaagttcagtcagaggaaacaacataccatgcaaggtgttctccaagcatattaatcttgttggagctaggtgtatatcgcctatgtcagggacataattctcctttatatcttccaatgttaagtaacagccgttacttgccatggtaggcattaccaaagcttgggaaagtactgcaatcccggcacattcatcaacaaaaatatgagctcgtttatcacaaagtacagagtaaggtggtgcgaaattcaagtgggagcggacagctatttggtttgccaatgttgttgacatgcaaaacaaaccctctgatttctcgccactgtgaaccctgccaccaagaatctcgtcagataatctagcttccaatgaacacgtatctgtatcttctaaattgatagtatctcccaatgaagcatcggtcacttggctccagaaatcttttgtcggtatcgtgaatgtgtcggatctgaaatcccctgcagaagaagtatacaaaggtggaataggcatattagtacacaattaacgacggagcctttgaaataattatgatctctgacaatctattgcacttcgtagtattggtgccgatcgatagtatttctttcatatgactgtatttaatgtcagctttatgttgcaactttctggtatcttatatttactattttcatttctatattttcgtatgacattatgcagccatattaactgtggatacgaagcttgtcacgtaattacagtgatattctatgcaaaccgcaggttatccatgaagaggaagatgagtaagttatataataaaacaataactgcaactaagagtgttaataacaggaaaactttttttttcttttaaatatgcgaggtaaactgattcgctctcataatataaataggaacatgatgactcaaggtgagtatgacaagaactataatcattctgatttgcttctttcttctagatgatggcatgtggctgttacacatgatcctaagaattcatgagaaaatggtgtgctgatatgagaagttttgatgaccacttcaggtagaaccttccatctccatatcatttcgtattcgtcacgttttccatgaatgtatattcttaggtattccaaatatacgatgtagaaataaacgccgaggccagtgagtaagtgccaccatccatgtaattctagcaatactcctagtggtaaccttaaatatgatcttctaatagtgatccaaaactgacagaaatgaacatcaagttgccagacgaaataaccagccagaaatatggtgataccaagtaacatagcattttgtaggttacgtttagcaaccggatcgtttacaaactgtgtggtgagtttgaaggcaaaccaaataacgatagcgttgattagagcgtaaccagcctgatggatcgttggattcttgaaaatgaggtatatagccgtaagtaaattagcacccataaagatggttaatccgacagtccattgttttctcctggtgggagacctgatcctcgacgtagctacatcaatctcctcgcagaatatgctccatgcaggaatgcaagtagcataaaccataggtaactcatctaataactggtacttgtattgcaaagtcatatggaataaccaggatccgatcccgaccaatccaaaaccagcacaaaccaacttaaaccgggtctctagtttatttttccatgaagaatacaacaggtataatgctagtaaaataaatccactattagtgagtgtgtttgaccattccgctatatagggcgatatcacataattctcctcacaccaatctatagtagaagtaggagtaccccagaaccctgattctggtggtgtcggataatctctgaagattccaaatagattcggtgacattttttttggtttcctttggttgtctttatggagtgtatcgattgtcctttgtggtattgattgtgcggtcttttaatataggtatactgagattactaatttttttattagaaccgataccctattttagaatgtcataggaaatgtccaaaatgggacagtaaggatttcccaataagaagcttcacgtaaatctaggatggaccacttccttatatacgttcagtgataccaacgagaaattgttctagcatatattctgcacttatataggagaaagagctttaataatatttttatatgcatcttcatatcgatactgttttgaaaaccccatagaatgcggcttattagagataaagtatcgttgttttccactatagggaaaaaaagaacaaagaattttggattgaccaggtgacttaaacgcttgaacgagggacattcaaggggaagagcaccgttgttcaaattaatcactcaaaatggtccgatcatggatttgaagagctcgttcaatattttttatggcggggttaatttctctataagcggtggtagaaagacggggaaggtgaaacgagaaagtgagaatgctaagaagtgaattttgtctattctataattgatacaacttttacttacaactgctgcaacaaagcaaattcaaagggcataatagatgtaggtagtttgcgtatatattgttttgttctttttgggagatcataagacacagtaggcaccatccactagtagatcggaaccggtagtgtatgtggatgcatccgaagcgaagtacaagtatgcaccgacaagttcttggggcaaaccttcacggcccatagggatcaacgaatgccatttgttcttcaaatcttcgtcaacgaagttcgaaattggggtagcgatgtaacctggggacacggtattgacacgagcgaagccagcccattcgacggccaaagatttagcgaaatggatgacaccggccttggcagcattgtaacaggcttgcaattgagggatattcacgatgtgaccagacatcgacgcagtgataaccatggacccgcttccttggcgtttgaattgggcacccacgtacttggcacagtagtaaacaccattgaaatcggtatggatcactttgttccattcatcggtatcggtcccactttccgctgcttccactagcggacctttagtccatggaacaccagcgttggcgataaaaacgtcaatcttaccgaactcttggataacgtcttcgatagttttctttactttggcttcttcggtgacgggacactggtatgcgaccactttcacgttgtatttagctgataactccacagctctttcgaccaatgcggcattggaattataccataccgcaagagaggcaccagcttgtgcaagcccttcagccacggcatacccgataccagaagaggcaccagtcacgacagccactttccccttcaaggagaacagatcaagtacgttgctggccaactttggaggctcttgaggggtaggcaattcggtagctaatgtatagggcataatgatagtatgtttcttgggtattgtatatgtagtttctttagtttactactaataatgctcaacgttcaaagtttgcaaaccgaaacatccatcagttaagtaagattatgcatcatgtctggtctctctttatataatctggcatggctatggaacacttcagaatttgttttaagtcagtcagcgtttcttgacagtttcattagggggaaaacaattcgaatgcctaaaaaatcgggaaatctcaacgaacctttctacgtccgttgctaccagttggagaacggatgaatattgttcggtacccatacctagtacccagttcggggaaacgaaatactgtagcaaaacgcagaaacgcgtcatgaccgtgtcccaatggtgtaaagttggaagaacttgttgcaattccatgacagcaatattttccgtgatatttcttgagttcggtgcgccgctttcttaagggattgttattgaattacgtattcagagaacagaaaccgtcatgtcaatctttttgtggcaaaaaaaaaaaaaaaaaaacatgaaaactaaaaaaacgtcagtggaggaatgttgagtcacgtgcggagatccaagaatttccttcgtttgtggtgtatgggtgtttatgtgttggcgatggagtactactttcaagagagagcacattcgacttacgacaggctgctcagcgtacctgcctccgtggccacttacgcttataccgtggctattcaacacagtgcagaatacattcgtactctcgtgccttcccactggttcattgatccgtgaaatatgtaatcatcggtgaatgcagatgagtatatagacagttgaaaaatttatttttagcaagtgaaagttctctcctttactacacaccatactatctgcctaagtaaaactgtagccaaaggaaacaagtcgagatatcattctaaatcatcgctgtttcgacctccctcactcctcactttctttcacttcaaaatctcagtgcattattgacaaaaacgcgcgtgccagctattaaatcgctgtaattactactattgttattaatattgatctgtctctcttcttttttttttcattttccgtacgttattagttgattcaatccgctagatttcccaacacaacaagggtttacatattctattatcggtttacgttgacgttactaaatttggggatctacattcaagacagaatagtgaagcgtactgaattagcagggttaggaataattgagttatagggtatcgttttcgattctgatattctttcgttgtttattttcccatcgccacaagttttcataagacctctttcttttagcatacgatgggtagacgtaaaattaatatcgagccgataacgcacgagaggaataggaccgtgactttcatcaaacgtaaggccggtttgttcaagaaagctcacgagttagcggtgttatgtcaagttgatgttgccgtgataattcttggccacaacaacacgttttacgagttttcatctgttgacaccaatgatttgattcgtcattatcaaagcgatcagttagttcatgatataaaagagccatctgattatggggactacgttaaaaaggaacgcgttgtgctaagacctaatcggaaacgtaatgctgcgaatagaaatgctgctaatgctgctgttggtcctaatgtgggtgccgcagatacatcatcttctgtaaattctcccgattcaagacgcgtcaagagacagctgagaagtaaaggatctgtgtcgacaagatcaatgagtaacggaactcaacatggggatgataatgaggacgatttggatgatgatgatatggatgacgatgatatagatgacgatgatatagatgacgatgacgacgatgatatagaagatgatgatatagacaatgagggtggtgatggtgatataaatgatagtgtcacggaaagccgcgatcacagcaattcttcgactatgagcaatcgtggtaggtctacaaaatcgcagaggtctaacgcaacgaaaaagaacaagacccgatcaagaacagtagatagttcagtcaacttgtcaacttcaaatgataaaagtattgacaatgatggatccaaccctagaagtataggtagcagtggtatgaatatgacaggagctcattctgcttccgctactagtctgaactcaatgtcagcgagacattcgccgttcgtggacatgaagacgtcctctttgccaaaacaacaagggtcatcatccggcgtcgaacttaatgcaggattgaagtttaacccattacaagaacacgtacaaagacaattccataatctttacaattctaaagaaccaaggataggaacacctgtcatccaacctcaaatggttaactcaggcttctcaagaaacaacatgagtcgcatacaggatagctccgacgtgggatcaaagttaactgtacaatcaccaatgactgctttaagaacaatgctgggaggtactaccacaccgtctccaacggatgaaagtccacagcatgcttctggacaaacaagaatgctgaagacacaccagcaacaaaagagaccagtgttaagggtggaaataccaacgaacaataccacactacctattaagagtgaaggtgattcggccgctagtgatggacagcctaaatcagcaactgattcacaacgcactccttcgaacgtcatgtcacaaccattgtcatcaagtcccgttataggagacaagtcgagaacttccgtgaattctgccgcaaatactggcttcctttacaacgaattaacttcagggtttgtagcatcgccttctgttccacagtatttcgctacgcctttacaagcacagaacaatgcaacatcgatgttgcaaattcaaaatccacagaattatctgatgcagagacaattacaatatgctcaacagcagcatcaaatgcaacaacaaagaatacaactgaataatctacagccaaaaaatcgcaatcctggtcaaattttagccaccactactactacggatcataactcagggccattaacggggtctttgccttctaaatttgcacaggacttgattgtacagtctccaaatacatcaattggtggcatgttccaagaatggccattccctccaaatacaagtaccgcgggtcgatcgaacagttctttacctcatctgcagatgtctcatcaacaaactggagcgtcacaacagcacaactcattactcccgacagggcaacgtcaggcaatgacaagcacttctcaacaacaatctctgcaacaacatcaacaacaacaacaacaacaacaacaacatcaacaacaacaaccaagtaatgatcagacatctggtcagcaacaccaacagcagcatgttgtaagcaatggaagtcctggattatcgccctacatcaatgtcagtcaaacacccacaaacaaagcattcaacttcagcgatgcagggtcaacaacatatgggtcagataaaggatctgtagataaatgacaggaagattaggagttattccatttttttgagactagtgtataggacgcttcagatgcaaacaaccaccccggaatacgataaaaaaagtacttcggtcgttatatatctaacgatttgaaaagcatacacaagtttcattggaagcttcaatttcgatgttatttatattccgcttttatttgtaacactaaaccaacattcctgtaataaacactgtaaaagacgcttgtgtatatactatgaagatgacactaaagttgtaacattaatttgtgtgaattatgcgcaagattatatatctggtatacagataaatcaattgcaaactctaccatattacaatataacaagaatgcgcagttatgtttcatatcaatcacaacaagaaacagaagatgttatagtctaaagcttagttattgaatttcaacaaattcctctacattcctctacgttcctctacatgttgctcacgaataacgagttagacaccagtacgaagacaatgacgaagatacttgaaaaatgaaagttagggaagttttgatcacgtgctaatttgtgggactgtttaaagatgaacatcagtacattttttgttttgattttgtaaaacaaatgaaccattaccaaaaggggatattaaaaaaaaaaagacagaacagatgactggcaccggcctgattcgatcagcaattctgtaagcgcccttcccaactgtggtatcgtaggctggtgctccttcctctggaatgggattctctgtctggcatggatggttccctgccaggtttagcctactctgaatctgtccactatccttccatcctattgtactatgggaatcaggtctggtaacctcagagagtctcgcagtctgtcggtggctctcaacccagtttgcagactagctagtgggaaggcgtcgactgttcccaggccttccatcgttcacggtgcttgctctaggtagctgtgttcggtttgtggtttgagtccctctgtttggcaaaaccaggtttcaagctaaactttcgaaaattcacacaatcaagatgtgaaaattcatgaaagctttaaatgtgtatattgagcattttggtatagaacgtctataattcaataagactaggtagccatagcacaactaagccatcatgaaggtatgtgggacagtaatatagtgatcattgggaatcagagacaaataaaagcgagttatgtgggactttgaattaagaagagaaacgaaagtatcaacaatgtggtatataacatcagataccatcaggaatatacttataagaagaagaagcgtcatcaggtactacactgtgtatcgtcaattttcaccggaaatatacttattcgtggacagtaactgactagatctataatggaacaacaagaacaatctttagagaaacctaaaaagaaagcaagcgttataattgaacgtaaggaaataccaagcgtgaagaaggcatatcagtccctaggatataaatcatagtaagcaaatgctggtagtttttgaaaaactgtattctgacgatgattacgttcttatgaatggtgggaaatcgtttactctcgcataatatcaagaattggtacttcataccaatccgtctctgatccaccgatttcgatttcagcaaccctttcccgtttgaaacaatttactaacaatattggattattataattcatgaattttaatagttgaacatctcttacccaattaacggtactcaaaagtgcattgaaatcgatgatgaacaccgtgtccgtgtcttctacgacaagagaatcggtcaagaagttgatggtgaatccgtcggtgatgaattcaagggttacgtcttcaagattgccggtggtaacgacaagcaaggtttcccaatgaagcaaggtgttttgttgccaaccagagtcaagttgttgttggctaagggtcactcttgttacagaccaagaagaaatggtgaaagaaagagaaagtccgttagaggtgctatcgtcggtccagatttggctgttttggctttgatcatcaccaagaagggtgaacaagaaatcgaaggtatcactaacgacactgttccaaagagattgggtccaaagagagccaacaacatcagaaagttcttcggtttgaccaaggaagatgatgtccgtgactacgttatcagaagagaagttaccaagggtgacaagtcttacaccaaggctccaaagatccaaagattggttactcctcaaagattgcaaagaaagagacaacaaaagtccttgaagatcaagaacgctcaagctcaaagagaagctgctgctgaatatgctcaattgttggctaagagattgtctgaaagaaaggctgaaaaggctgaggttagaaagagaagagcttcttctttgaaggcttaaacatgtttcagtataatccaactggattttgtctaaaacatttttttaaaacttcattactctttgttacaatcaacttcattatgctttaatagcttttaccaatgtactttttagggagagtctataaattattctctaagtaatagtttcttatatatgtaaagaaaatattgttcataattaaatttgagttctattatcatcaactgtcaagattcgtaaattaggaacgtgtgttttctatacattgatcatacaaagcctctatttatttgtcctaagtcaaagttactagttcttcggcgctggttggatgaattgcaacacatgagtcgaaatcggctttagtggcgcccattttgatcgcaacaccgaatccttgtaaaatttctgcggaagagtcaccgataatgtgtagaccaacaaccttttcttcttcacctgtgcagactagtttatatcttgttggagtcttatctttctcttccatcattgcgtagtacatagcgttgaacttggaattgtagactttaacattatcctttccaaacttttcaatagcttcgcgctcacttaagccaatggatccagcttctggatgagagaatacaacacttgggacattttcataatcttgcttttggtttttaaacttctcaggaccaaacagtctgttggacaattttctaccagcagcaattgcaacaggggttagttccaccttcccaacgacatcacctaaagagtacacgtttttgacgctactattttggtactcgtcaacaacaatttgctcctttgcatccaactttacgcctatgttttccaatccgagacccagtaaggatctacgaccaattgtccaaataagagaatccacgttatcgatattctttccggtatccaactggatattcaatttgccagtagattcatccttttcaactttggtgacatttgaagatttatggatattaacaccttctttgatgtaagtatcagtgactgtttcttggatacagtcatcaaactttctcaaaacggtttcacctctgataacaagatgactatcggagccaaggccgttgaaaacacctgcaatttcaacaccaatgtacccagcacctacaactacaactttctttggttgatcctctaattcaaagaattcgtctgagctaacaccatagtcataacctgggatctttgctggataaattggtttgccaccggttgcaaccagaatatggtccgctgtgtaggtctcagtgcagttgtcggccttctttacttggactttaccgtccacagtgaaactggcccatccatatacataatcaaccccttccttggtcaaatttctctcataaattccattcaatctgtgaatgtaagcatcccttttcttcttgaattcaggccagttgaaggtcaaattttccttggtcaatggcaaatcctcgaataggttataactgtgcgcatgaccaatccgggtcgctaagtccgaagcataccacataaccttcttaggaacgcaacctttattaacacaagtaccacccatggctttggcctcgatcaacaaggtcttggcaccataagatgcagctcttctagaagaggcaacaccaccagaaccacccccaataactagataatcgtagtgcctaatcgaatcagacatgtttcttctaataatgattctattgattgtattacgtatggacataaccgtgccaatatgagtacaaaaaataaatcagtatcacctgcaattgaccaaaagatctttgcagagtgtaccttctttgaaaagtgtttgattctttgttctgactttttattctttttcggatatttatcatggcttgctttccttctgcaaagacagagaggctgacgaatcaggaacagaaaaacaaggtttcgaatagtatctcgaataaaggtgacacgagcagcaagatcacatgtgtataattatgtcacagcctttctttgtgaccattgaggcctgtgatcttttggaagttggctttaaactatgtattaacgaaaataggatgaaagattcttctattctaattattaatgatgaatagtgagtgtattcatatatatacgtacatttatgtatatttcatgctgaataaagcactaggtatgataatactggtgcattcgttaagcttcattagaatatctaaaattcagcttccatatgctggcatgtatgtgagtaatcttggtcattttgaccaaagggagtttaatgcaataattggatgtcgttccatttaactttaaatactaattttgagaagatttatgccgatgaagagttgtccagagtggaatgctcatcccattccttagttactgctggtttgggacgactgtttttgcggaaaaatttcgaccattctcttaccgctgttacgatggtgcagatgagacatgtcgttgtaatgagcacgcatgcagttgaataaatcacactaacaactcggaaagctgacattggaacatacggattaaattgaaggtacaattctttgcaaccaatggccatggttcccaaggggaaagtcataccccaccatgttttctgatatctataaattttggtgtgtgatcttgaatacgtcaatattccaatcacacacaagaaggtgaaaaagaatccggttgctagtaataacatggaaaaaataagtccaaaaatctggaaagaccatccaatagcaacctttgcgatgtatccgtttaagtctatattgggatccacgggatagtagagatcgatgtataatttcacatccgttgttaaccaaactataccataggcaccttgacccaagggaccgagacaaagaaacaaggagaagattttcttcgcctctggtaatttattaacatacaaattccagacatatattccaagtataatagcgacaaatacaatagcgtgtagccaaatcaaaaaagtaataatcaaggtgactaactgaatattccgattgaaagtccttgtaaatagatcagacattatgaaggtaccgctggctgaacacgcaacaacaagcgtgatgacagggagcaataaaaacgtctgtagatcttctttcatagccttgttttccggtgaatcgaccatctcgatgtccggagtctcaccaaaataatgattgtagtctttccagatgataaaagttataccccatgcgataacaagtgaaattgcaatatcgtaccaccataatatataaaccacatacattaagggctttgcgtgttttgtgttgacaacttcatcgcttgttgcaatcataaagatatagctgaggattgtttggagtcccatggcataagtaccccaaaatacattgttatcaatgtttttgaaagtattccaataatagttcttcctcttgtgtgaatgctgagagtataggataaattggacaactgcgatgacctgtaaaaaaatgaacaatatgctaacaattgcaaagaaaatgtacgagcatcgtaccaaccaccttgccggatatggaaagctatgtagaattgaggcagagatacccgttcccatgcaagtgatgaaccagaaaggtgaaaactgttcaatccattcttcctgaatgaatcgcaataataatgacatgatgtttcttttaagattaatgatgtatcaatgctcccctcgataagtagaagttacctttctaataaatgcaaaaaagtgaatttattcaaacgaacaagttcagatgataatttggcaagcttcaacggtgttttcaccacaagccaaaccttgaagcagaaaaaggtagaaaacctaaaatgatccaaaaaaactggagaattagaaagacctgaccagagtaataccaacctttgggtcctctgatgtgcaaatagcttttcgacagtaaaggcaaagatatatgttttttttccttccagaaatattagtcttggttctcttttttaatcgaaagcctttcctttactagtcttacttgcatcatgaacgttgcgaggacaagactcataggtgccaaaaaaaaaccaaatacaactggcacttatataataatgggaaagtttaatgttaccaccagccagaacggaactttggctatggctactcagttcattcagctcagctcttgcagatcttttgatgccacctgcctggtgtttttcaagcaacatgggatgaataaggaacacatagtgaactcagtaactaaggagttttcaccataaccgacggcacgaagaaatttctttgtgccgtacgtaaagatcaatgtgtcatacactggttcgcttcacagttgtatgtattgtaaaaatggacagcctagacaggtgggcagcggggcgcatccaagggccataattgtggaggcgacatgagtcaattccggattcttattggctgagagcatttcttttctgttcttcttctggatccttaagaccgatcattcattcgagaggttctatcagggaacaaagtgataagaccccattaaatgtaaaaaacatagtgataggaccccagtatatgtataacacaatgataggaccccattatatataaccctacgtaatcactattggttagtaatagttataagcttaatatttgtttatgtaaataaggttagaatagaatcatacgtcactttgcgaagactgtctacgttttttacctttgatcattagatacacgattccagcgatcgtagcacagtcacagaatgcaagaccagtgaaacaccatccagcccccattgcctcgattaatttgaaaactattgctgatgctactgctgcggctgcgtttctgaaaaaactactgatagaaaccagggttgctgtctttttcctatccagttctgtcaaaaatgtcatcgtagcatttgagcaccacgtcataccgaatgccaacaagaaagaaaaaaccaatataacgactatatgtagttccttttcaatggcccagccaaaaccgcagcaaccggccatgctaatcgctagaccccaaatttgaaaccagagcctatactctggaatccatttctttgattttgccttgaaaaaatctgataggtgacctccacttaatgaaccacatagtaatccaataccaggacacacgtaacaagcaccaatttggaggttgttgaaaccgaatctcgaatggagctcatgcgataaaataacactgaaacagtagtatgaggagaataggattgctgttgaaatggaacatataatgactctcaactcaagaaatgtcagataatatgaacgccatgttggcttaggtggccttgggtacaatttggcaaatactggagtgtcgttgactggtttctgtaggcccaagtcacggaataattgcatgtgtggcttgacaacggactcttcctttgtttgtgaagattcctctatacttaacgaagctggaaattctgaatcttccttccaccgtggatcaccattcccaacgatacatcgaagagtttccggcaaaaacgttactattagaattaaccccacgccagtagtaatagaagtgaacccgaataaccatctccattgattaccattcattaatattaaccctccaaatatgggcccaagaattgggcccatatttggtcctaacatgaaatatgagacacctttggctctattcattggagatataaggtcactgacagttccaacccctaacggaattacagcactagttccaatggcttgaaacactcttaagatgtaaagagcggccaaatgcttaggaaccgctgcaagaagaacgttggcaataagtgcaatcattaaggagaaaatgtacaagaatttcctacctccaaaatcagcatgtactgcccacaagaagggtcctactgcaaaaacacccataaatgcagcaactgtaccattgatagcagttgtgctagtattaaattcggattgaagaataggtagtgcgggaatgtaaatgttacctgtcacgggtcctaagaacccaatgtaaattataattaatagtatgctcacaacctgatagtttgaaaacgcactatatggtggattatatgcaatttcaggttctagagctgtgaaagccgtttctggatgtttctcgttgcgtactatagaactttgctcttccttcgacttgtcactatcaaaatctgtgtcttttatttcactgatatctgtcatatcagactctttttctaaacgattctcatttgggtttatcgatatattagaggctgtaatcaacggcgatggtaagccttccatttttttttcgatattttgaattgtcttgctgttgtgagaccctgatgatagaatactgttacttcgattcacgcccatacttgtatagcgataaattaagactctttatttataaaatctggtatttgagccaatggtcttggatatgctccaaagcgttgttagagcaaaactgaatatcttgttttaccttcaatatgagtctttatagctcaatgctctcttatttgctcattttgtgacatcttaaaactgacaccgggaatttttcttcgaaaatcatacgaacacttttcagacggaaagcaccttttacaattgacatatacaaagagcatatatcgttttgtagagttttattggagcttttatgtcacccgtactttcaagtgctaaaatctcatggcttatatgttactgagagtcaattttttgtgaaagaggcctacctagatgtgtgttgtgaagccgtccttttttttcttgccctgtactaagggcacataggagagagaaaaaaaaaactgtcgcctgataaaccgatagagaaataatagaggcaatcaaatataactcaagcaaaatgatgttggtcgacggttaaatattccaggtatactgagattgttttggtgaaatatttatgtcagtgtttcctttttttctattttatttagatcctacaattttcatcctttttattcttcaagattagtcaataactttcaaagataaaattgttactgaggtcagagggatgttggttatttggtcaaggaaaagcaaatcaaaggtataactcttataattttacagagtacgtaactattttacaaataaaggagtaataattaaatttaacccacccaatgcagacaaataaatgaaagtagtgactaatatatatagttcaatagagatagaaaagaaattggcaacacgataatatatgttcgaaatcaccagtgatggaaaggaaggaagaacagacagtttaacggaaatcagtcttaccaacaccacgcttacctgagaacaaatgttttggtagagaggcagtagcatgtctgtcagattcaccggctctggccattctgtttctttctcttctttctaatttggccattctttcagccttcgatctcattgaaccatcagcaacaccgtctgtcaatctatctgtctgtcttagcttaccagctggagcagaatcttcttgatcaccgtataccacgtcagcaccagtttgctcatatctgttcttttcagcagcgactctttgcttatcttgcaaagcagtcatatcgtgacctaaagaagacatgtgcttctccatgtcaccatatgtctttgccaatttagaacgaggcatggtaccacggttcttcaatgcctttctgtttcttgaagcattgatcatcttcttttgtctatctctaatccattctgccttttctctgatctcagagatttcgtcagcatcaaatccttcgtaagtttcttcttcgtcggattcatagaagccttcagattctaatctttcttcttcttcctctaaagcttgtaatttgattgcgatttctggatccaagaagtcataaacgttcttaccatctaagatttctggcatgacatcgttcttccattcatcgtcttccaatagatacttgtccttcaaattaacgttgtatacaccggccccaccgttttcgatttcaatttctttagccaattttcttctgtttggatcttctggatcatatttcttcatcttagcgatggcttctggaatatatggagttctgtcaataccatcatcacgcttttgaggttgagcgacgtggatcttgtttaagacgttagtgattctagcttgagattttagcttgttttcaattctggaagccaacaacttttcacaagccttgtttctaacagccataacgttatcttcttcatgacaagaagtggtcatgatttcaacacctggaacttccaaaacagtatccaaaagtttcttacgttcttcgtctaaatcttcaggtttaatgatatcagtcttgttaatgacgaccatgacggatttattggcaaacaatggtttgatcgaatggaataatttgacttgagcttcaatagagaaaccacactgttctgatagatccatgaagtacataacagtagaacgcaaatgagcaatagcataaatggattgcatttcgacgttgttcatttcatccgtaggtctatccaagatacctggagtatcaatcgcttggaatctcaagtatttataatcaaaatgacccacatatagcgacttggtggtgaaagcataaggttgcacttcgacatcagccttagtgatacatctcaagaaagaggatttacccacatttggataaccgcaaatcaacaaagttctggtgtttgggtcgatggatggcattctacccaaatgttgtctaacttgttccaaatacactaaaggatccttcaacttcttcacaatggtagccattctaccaagagcggctctcttcaattgtttacattggaaaagagattgaccgaattttaacaatcttgtgtaatctctttcaacttgttcgaccaatgtcttagcacgactcacagcagccaaagaaactttgaaatgattcttttcatacaaagtatccatcaaatccctatggaaaggatgcacgtcgttaatattagggaaacctttcaaaatatcatcaaatttttccacgaacccttcaccggtgaacttcacctttctcatgtaaaacgctctgatacgagtgatattgaaacctggtctaataacagtaggtgtctttctttgagttctgttcaacacaatgtccaacaagtcattggcaggagccacggtcggaatatctttccaggataattgcattgttgcttaattgatttgacgtaaactttgggatacacgcacacacggggacaacaaaaaacaattaaactagcaataatgcagttaagctatgcttagttgtttgaacaaacttccaatctattcaaactacctgtcaaacggatgtcacactgataatcaagctctgtctatcacttcgaatgcacaatgagatgagatgagatgagatgagcttgccgtttggaaaattttcccactactgcaaacctttgaaaagaaaaaaaaaattgtgctttcaggatttctttttcgtatggatctcagaattgaccgttaaaggcatacacattggttatgtcacgtgactaaagcactttcttttgagactgtcggggtaacaatatattttactgttaaaatgtatgtgaacattttatttacggtttacgtttcaactttcaatatatacagaaatatcaatgagattttgatctgaaagaatacagcttgagtccaatctctagattcattataactttctaatcactacctgataattgcctaatttccggtagaattgccttatccgccttttttttttgaatttttctcttcaaatatagatttgtttcgttactatgtcggaaccaagcccacaatctacgatagccattgccaatctactcaggactcatagcgacttgaagcaaagacaaggattgttccaatcgcgtttagttgacttcttccgttataaaagatttgttagagctttgaaaagtgataaatataaggcaaagtccaaaaaacaacccgaattgtaccccgctgtgacaagcgatgaagatgctcgtaacatttttgtttccttaatcaaggcccaatttgtcgtaccagcggttaaattacattctgcagaatgtaaagaacatggtctaaagccaaacaaatcatatccaaacttattattatcgaataaagcgactctacaaccagatgaatattacgtctggtcttataatccaaaatcaatttatgattacttgactgtgatcggtatcatagtcggtgtgctagcattcgtgtgttacccattatggcctccatatatgaaacgtggtacttactacttatccattgcagcattggcacttatcggtgtattctttggtattgcaattgtgagattgatagtttacttgttgtcattagctgcagttagcgagaagggtgggttctggctcttcccaaacttgttcgaagattgcggtgttatagaaagtttcaaaccgctatatggatttggtgaaaaggaatgctatagcttcctgaagaaagaaaagagaaagcatagatcagttgcaaagaagcaaaaataacttcaatgtaacggacttccatcccagactgtacattagcaatttaactatcacagaaggtgtatgttcattctttcggtgagaatcacatactaatatcacatataaacatacaaacatatataaatatagatatatgtactcatactaatatcagtagtgacatctttggtttctgacactagaaatcaccttcttttaaagttttattttgcatgaattgatttaaggtcaagtaagaaaatgaaaaacgcagcaacagtaatgaaaacagtaatgaaagcagaagttgcaaacagttagaaaaataatgccaacaggataccactcgcttccaatcctagtataggtattataactgagcgaacggccgcaccacaatattacaaacttctgcaacatgtcacagaaggaaatatcgcagaattctaatagaagaagctctaaatatgaagatgagttgagcaacgatgccccgtttgaaatttcatcacatcagttggagtcaagtacaactttaacagatgttcaaatgagtaaccttctacaaaggcattcttctcatcgtcgtgataggtcgagagatcatatgttttattctcatttgacacaacaatcatactctctcaacagaaacagtcttctcgattccattaccgtggtcaggcctttgatcaacgatttgatcactgaaaataatcaaagagccatctatattccagagcattctgaatctttggacgtattggaacttaaagtcaaactagatggtagggagaatatgcaacttgataagagtgctttggcgcagttattcaaaacacaagcgttatctgcgattgaccatttgattaatttacaaactcgtgtacaggatacttcttcaaaagttttcataacaggcgatttgaactcaggaaaatctacgttatgtaacgcatttttgagaaagaaggttttgcctgaggatcaattgccttgtaccaatgtattctgtgaaattttagaagcgagagagaacggaaatatggaaagagtccatgccattcccaagaccgtggcaactaacgttaaggatgcatccgtattatacgacatgagagacagatcgacttatgaagattatactctcgataagctagatcaattggtttatgataatgatcactatatcttgttgaagatatatattaaagatgataaaaggccggttgactctagtttgttgagaaacggaactgcagatatatctcttattgactctcctgggcttaatatggattcagtgaaaacaactgaagtgatgtctaggcaagaagagattgatcttgtagtatttgtcgtcaatgccgaaaatcaattaacattatctgctagagaattcattactatggcttcaagggagaagaaattaatgttcttcgtgatcaacaagtttgatcatatcaaggacaaagacagatgcaagaagctgattctagatcagatcaaggaaatttctccagaaacttataagcagaatagtgaatttgtacactttgttaccagtcatggtaaaataccccatgaaggcgaaaatcgccctgatggaggagatgacccaaatggagacatgccaaaccctccaaaagaagatcctgatttcgataaattagaggacaatttgcgtaatttcgtcttcaagaaaagatcactctcgaaacttttaccagcaaaaacttatctaataaagctattgaaggatcttgaaaggatatcacaatgtaatcttgaaaaatataaagaggaagactatcatttgaatgcccttctaattgatttgcaaccggaactccacgatgttaccaatcgctgttctgagcttatcgaatcaattgataaaatttgcgaatttaccacaaaggaagtatatggatacacaaaaatgcaaattaacaaagcgttaatactaaagcctgctgaattccctccatattctggtctttctggcatttatgactatgttcaacgagttagaactttcatcgtggaccaaattttagccagcgtacaagtcagtgaagcatatgctaagaacagcgcagaacaatcagtttctcaaataaacgcattagcgaaggaacaactaggtgatgaatttatggcgggcaaggttttcaagagtggtttgatgttcaccaagaaaaagcataatttaagcaaaaaattgaatattccattagaattgcataactttttggatccatctgttgaaggatttatctcttacctatcctggggtctcgttaaaccaacaccgaaaattactaacgaagagaatactttgactaccaaaagctcatggtcgcaatcccttgcattaacatcatattctgtttcacagtattggaccaacccatcgttaatctttacttcaaagatcccaacattactggtctattcctttgggggttctaaaatgataacaaatatcgtgcttcatggctcaaggtttttctctttagaatccttgaaaaaattgtctggatcgttgatactgctagggggagtcttaggaatagcctatttaattcacgacttaccaagagcgctaccgatgaagttatccttgaaatataagctacgattacaagaaatcgattatgcgcataataacgctgaccgtatctcgaaagaagtatcacaggtgttcaaatacccaaccagagaagtggtaaaagcgtgtgagttaattgttgataaaaagacttcccaaaagaaagaagtagaatgcaaagtaagggataacgcaatgagtattgaatttttccaggcgttattatccaagtcacagaaacagagaggtactgtggaatcgatcaatttggaagtagattgattaaatggatctatgggcattacaggaccctaaagaacagaatcattcttctatctgaaaccatatataattattcccatatgatagtttttcatgtaaatatttcattactgctgcggatccgaaccaactaaacatatttacaaccttactttcggtcccctttcccctccatggctcatgcgagacccttcgttcataacctccggatccttcggctgatatttttacggtccgaaaatcaaacacctgtagcatcaccagaacccatttcaaatgcgaaatatataaagatggaaacagaatcaaggaacgagccacagatattctgacttattttatttatcttcataaaattggttatatactttggtaatatttttcgtctaccctatttgtgtactgacacaacgacgttgtctcttatctaataaacgttgacaataatggtgaacttattattcaacccactgcactggggttacaatggtactgtaactcaacatatcggtgaaaaaggaacaatcaagttgcaaaagaaagatggatccgaggctcaattgcatgaattaatctccgaagaggttactggattgagcgatggcagcaaatttcaattaagtccactaatctttactggtattttacaaaccatgtatttggcaggtggtgatttcagcaagaaattcaatgtattttacggtagagaactgtttgagatgtctgatcatgggattgccagtattgattgggttagaaatgactggaagaaactgtacgaactagaccctgccaccggtacatacaataaagagaaactagctgaggatggtaaaaagacacatcctgaaggctggcctcgtttgcatccacgtactagatacatggatgacgaagaaaaagagtctgttttgaacgatacaagtaagccattgatcattgttatgcatggtttggctggtggtagccatgaaccaatcatcagatcattaacggagcaactttcaaatatctctaatgagaagtttaaagtggccgtgttgaacaccagaggttgtgcacgtacaaaagttgtatcaccgaaattgttctatgcgtttgcaacagaagatctgcgtgagtttgtgcaaagagaacacaagcgtgatccaaagagaaagatttatgctgttgggttttcattcggtgcaacaatgttggctaatttcctgggagaagaaggagaaaagtgtcttttatcaggtgctgcattagtatgtaatccttgggacttgactaattctgcccataaaatgagggaagacttctggtctagtcgtttgttcgcaaagagtatcactcaatttttagtaagaacactggaagttaacatgaatcaaatcgaatggaagggcggtgagaagcctgctgagatttcgccagaacactattcgaattattctttcacacgtgaaaacttgaaaaaagctaagcagttcactgatccaagtcagtttgatgacatttttacagcaaaggctgttggattcgaagactcctggtcttattaccgtgtcggaagctctattaaccgtctaccaactataaatgttccaactctagtcatcaattccaaagatgacccagtcataggtgataaatgtattccagtgaaggaagctgaggaaaatcctcatgttttactgatcgaaacagatttaggtggccatttagcttacttggagaaaaaccatgactcttgggcaacaaagcaggttgcccaatattttgatgctcttgaatcattagtcaaataaagtaatgtcaatgtttaaaacatttgtacacaagatactattcatatataagttcaatattatacataactgaagttaaaagcaaacatgctggttactcatgaaccatcttctcctctttgctgcttccaggctgtagaaccactttctctaccttttgtacctgtcaatgtagtcgtcgatgtatctttcgatggctttgtcttctccaatgataatcgctcttgttcatctcggcacgccagagcgtatatttgatcatcattgaaatcttttctcaatgtcttagttaggtaagtacacataaaattcagttcgttctcagatatggcattacgaggtaggttattttgtaggatatatctgccactaacatctgctacaatgtcattactgaaagccaaaacataactcatcttcttgttccaattcttcgagtaaatatgaggctcatcaaaactttgttcgcagcaatctaaatgaacccatctttttaaattgggtgaatagtactcgcaccatacatgatcctctttgttccaaatatatcttgcgtttaacccgaacgatttcaaaatcaaggtgaacacattacaccattctccacaccttcctgttcttgtctgaagtaactttatcggatcattataacgcggaaatcttgtgatatcaccagtaagggtgcagcggtatacttcgacgttcccacattgatatttggcttcctcactgtttgctctatctgtacccacccattcgagatgttcgtcagtgccacatttggaacaattaggtttgttacaccatgagaagaaatctcttttgaagtacctgagaagctctttcaccaaatagtcctgatattcaatatccgaagcattattatcttgaacagctttgtcaacgttgctgtatattaaatcaagatctaatatatctaatactacggagtaccatgcgtcattctcatacctgaaacataatgatttataaagaccaaatatctgtcgagcaaaaccgttttgctgtataagagagttgaaacgtttctcttcctcggaggagccattagtccccctccattgggacagaatcttggaacggtatagttctaggaatctcttagaaacagacgataaagtctcctgaaagtcagtcattattactttctcaatagatattatcgatcaggcagtgatgcaccagtgcttaccttaaaatcacaatcctcatgtattgttctgtatgtgtcaaaatacttttttaacatggcgacatgtaattccctgattgaacctttaaaattcaaattcatcatgaagttcaagacaagaaggcaacgattttatgattgctcattggaatagagaggatgtccaacaactttccttcaatttatggctaccaagttgtattacactaaatgtcaataggataccaatcattggatttaatttagtaactggagaccagaatttggatatcattcacacttttagaactgaagttgaagatcagcatgggttcttcagattcaaaccacgatcgaaatacaatatgcgaaaacaaacgtgttgcttacatattattcggactgtccaacctcatatttttagtgggattggctagcatggttttgtgctggaataggccagagtacttttattactgttccgttgtcctgctgctacctgtcacactatggctgtggtccgttatctcttggtctgcttcccaatactttgcatacgggaaatataggatggtgtaattatctgtgatcatattatcattatatggagcactatttacaagataaagtccattgaatgggaactttatatacctatttacaaaggaatgccttattcttatttgtgtaaccgcagttgtattatcatatgcattcaatgacatagcatttttgtttaccaaccctcaacaaaagcaccctttcatctatcaaaaacgggctaaagtttgtggtgtcatccactactttgttcttatttggtcctagatagatggatccttgtttgattctcctcctggactcagtctttgaacaatcgatcaattgacacacaatatcagacaatggcgtattgatcggtatcttgttcaaaattctattctcatcgaagactctgatcagttcagctgccttaacgttttcaaaacctgaaccaccaaataaaattcgcgatacaaactctgcatcgtcacctttaccaattccatgaatcagatccacaacttctttagctaaccttttttgagcgtatctttcatttggcgatagtgcgtgttgagccatgatgtcttcaattaattccaacggtaacagagtaaagatcttcaattgctttgccacatctgcatcagtagtattcacgaagaactgatacatatcataggaggtattgatttcagggtcaatgaatactgcattacccgccgatttaccgaatttttctccagtggaggtcgtcaataagggcaccgttaaaccaaaagctggacgagtcttcacatgctggggagaaattctgttgataagatcgatacccgctgtaatattaccccattgatcgttaccaccaacttggatggacacttgttcatttgagtacaaatggtagaaatcgtatgcttgtaagatctgatacgtgaattcgttgaaaccaataccatcttgactttgcaatctcgaagaaacggaatcacgactcaacatgttctgtatacgaatatgtttaccgtaagtagcaaggaaatctaacatcttaacatcctgccaccacgaaatattgtttagataggtgaccttacctggtgcatctctttccttaatcctagactcgtagtatttcaatccattcgtgaaaaatgtcttgtactgttccacaatcctttcaatgttcccttgtctctttgcttcagcgataacatccctctcagttttcctcccacttgggtcaccaactttgccggtggccccaccaattaacgaaacgacgtcatgccctctcacataaaagttcaaaagaaccattaagggcagtaaattacccaaatgcaaagatttcgcagtgggatctgctccacaatatagtttgatcttatcaccattactcagtttctcagacaataacttctccggctgtgaaacctgctgaaccaaccctctctctcgaagaacctgcaatacatcgcatttcgttgccaaatttctcacaagcaacctcccaaatatcattgcaacttcgaagctttcaaagcagaaagatcaactgttagtatatattaaaaaagataaagctttaacaacctactacggccaatggcgctgtccaagactgacctttaggcagttttctcgtctgaacttcaaagtcacatcaaatcggactcgaatcgaaattttcgaagttttcaaactagaaaaaagaatcaaattactgtaccaaatgtatgaacgaccaactccacaaaacgtaacggaattaaccagggtctcgctctctttccagacatccaagactaacgcgcgcacagataacacgaaccacgacttgaaccagaaatgccaccaccaccaaaagtttacggccaacaacaacaaccttcgaactgggaaaagttcaagatgggtttgatgatgggtactaccgttggtgtttgtactggcatcttattcggtggtgttgccattgttacacaaggcccaggtccaaacgggtttgtgagaaccttagggcagtacatcgctggttctgctgccacttttggcctatttatgagtatcggttctgtcattagaagtgatggaacttccgacaactcccacaacaatggtttctaccatagtaagatggccgaattgcaacagagatcaagatttgaagtatggaaagctaaacaaacttatggtttgtacaaggattaagcgtttttacccagcaattgtacatgggtcagaggcagcggtacctactaatcttttcgtatctactctatttctgtcctctcggtatatttttaagtaaaatgaatattgtaaataggaatttaagatgatcaatttttcgagaggagctgatgaagtaaagaacctggggagattacagtacacacgtagggatcacaaaggcatactgcgagcttcagaatttgtttccattgcagttagtgaacggtgtaaacacacactttggtatattcgtaccgttttttctatttggaagaagttgacatagatagtagaacaataatgttcagaccgttggtgaaaagagtcgtaactcgccgttttctagcggctgctaataacagtaatgcccatatagagatcaggactctagaagatcttgccaagcttcaatcactcgataacgtggatcctaagttaattagtaagttaatcaatgacaagactaacgagcttaatattaagaacgaactacagatgttgaaacagttacaggcagaagaacagaagacacaggagacttctctcaagaagtttgttaggccagcatggatctttctactaatgggttctatcgtatatctttcttgtcattatgtatggtggaaattagattacgaggaaaaagaactcgaatatacgcataaagtgcaccagttggaaagcgaactagctgcattgaacgaagcacacaattcttcggtatcttcagataaaaattctaaaaggtcaagcaggaagtggtataaattttggtaaattgacgctagggatgatcctctattgaatcatctagagattgtcattttttctcccagtattatatatgtatatatcttctgtacggacgtagctacacagcttaatcaattaaaggacgaaatggaatattcagtacgcgcacacattaggcattaaaatagttattcttttctcaatcgaaagtgttactctttactagcgtacacgggcccacttcatttctcggaatggagtatacaagataattaccatcttctccacaaatatgtatagtgtttgtagtatccttcgggaagccaatgcgatatttcgcattttcaggtatcttaatatatgctacgtgtcgctgttggctttgtgtaggaatcttcgatacaataattttcccaaaacggttcgcaagacctttcgatatgtattgtagcccattgatactgctagataaagaatgagaactttgttgcaaagtgtcatcttcattcgcgtcagcttcggtagttgtcaccggcaaggcaaagatatggatagtgtccgattccccaacacatgctagtagcgtattatcatgattgaacttcatttcacttattcgacttggccttgagcctcttctgaattcgttaacaaggataggttcgtcattttcagtgtcaatagttttgaatacccttatgattgtacccttctcagaggcagttgccattagcataccgtcaggagaacacgcgatacatactatattactttgatgcacagcgggtaatacgttgatctgtatgcatttcagcgcatcaaatacaacgatatcattcaatggagcattctctttgtctgattttgaatacgatgagtaacataagatactattattgtcagtgcttaatgatactctcacaccaatatcaccaacagcctcactatttctgaacttgcttgtgcttttcagtttctctcctctaacgtcgatggttcgtaacagtttcatgcatgaaatatcataaacaaatatctggtcacttttcaatacaacacatatgatttttctattcattatgacatccataatctcgtgtgggaacgtaagttcacatatcgtagccttccgtttagtgtttactatctttaatttcttcctctttgatgcgccaatggttttatctacaacggctatcaagctagtagaaaacaacatctcaactagaaaatctagctcttcgtcatttgaagttgatttctccaattcgaaacacttaccaaatggatcacagttgtaaatggtaacccctttattagacgagatcacagagaaacacgtcgcatcttgattaaatcctaatagcttcaatgccatcctaattaaaccgatttatcccttgtaccaaaagctcattcaacagctaccttatcagttaatactccaactgcgtttccgcaatattcatcgatgacgtgaacgtgtactttgacttttggatatcaagtaaatatataccttttgtgcctcaccctcgtgaaatggtgtcataaacgtttgatattgcatatcagcttttaactttattcaaattctctatataaagcattaacatagtaaattaagagcttccactaagtatatgaagaaacgtgaaattgctgaaaaagaggaatcacgtgcacggtgttccttaagataagtgacacggcttcgtatgtggttttagaaatctaagttcgtggtatgagattgttgatgttcatcttgaggtggacgtgccttctgcattgatgagtctttattttttttattggaatcatcttcgtcttccactgggataccccattcttctatctcaaatctctttcttccattcttgaacgcccattcagacttggaaacgtgcatttcacctcgttcactgaacaccggaagtttcttgatatgtactaaaccgtgttgaatcttatttggttgggatttgtatgctctttccaaaaactgaagcatctcctggccgaatggttcaaggacgattacaccgtcgaagagttgttcaatctgagccgtgaaaagtggttggttgtgatagagactggttgagattgtagagagcatcacacatctttccttatatttcttcaatagagatctgagtccgtgtagtaacggaattaattcatggagttgtgtcatcttgggtgggtatagagctggatgcaagagatttggcaataaaattcttatcagcttcgaattatgtctcttgattatcgattccatttgggaaagaacagatgctgcgggcagtaatggggaaatgaacgaaatttcgttcgatgttggagctggaattagggtggacgtaatgtcaaattgatggttataatcgggataagtttcactttggtcaacttcacgagaagattctgattttgcagaatcgtcgttcatgccatacctccatgcgatttttaggtccttgtttctctgtgccgatgtattcgattttgattgggactctaaaagatttgagacagtgaccttggactgttcctgtgctatctttgactttttgatatcctttctggaacctttgtacacgccaggtagctctttggttaggtggtggtttaaagataatacgatcaaatgtgtattaccatctttaaaaccatgcgatccttcgatacggttatgtacaataccttgtgatgcatacactttggttaaaatggaattaaagtcggtcgtagattcttcttctatcaaaagagagcaacccaaagggaaccctgagtgacccattagtttatccaagtctgtacaccccgtggatgttgtttgttgtgatgtagcaggagaaggccgtatcccaggatgaactgcactgaagccagatgaggcctccgcttgcgggatggcctgcgcggtacgtcccgaaatatgtagacctttcaaatctcgatgaacatttccaatatttggaaccacacgtccaggtgctgcaccacccatcggtcctctacttattgcaccagatggtctttgtgcattgtttcttgatggcatatctcttggaatcatcccacctggaacaatgtttctcctagcagcattcccgtcgctcaaaacttcacctcttttcctgaatgacatattgtttatagagcaatgaccagcaagtgttgttacccctacctgatacttgaatactctaagctcgttgtctaacactggcgatgagttgtctcttattattatgctttcattttttgaatatttcaatcttttcagaatattgaaaagaaacaaatcatatggatagaagcatcaaacgataaagatgtctgcgatgttatgcgaaaacaaaagcaaactccaaactaacactcaaccagactatttgagactagaaaattgccctataataggacaatgctttcagacacctgtttttgagttgcgttaagactgttaaacgatagtaattcctttagaataactgtttcaaagtaaaggtatacgaacgggaatatactgcggttatgtacaggatacgtaccggcaatctagtgcaaaggttgaatctggcaagaaattatactcaaaaaagtacgaaacaaactagaaggaccggactgaaaattctcttgtacttttcgataccgtacaccggctatgcattatatgtattcggcagcacaaactatgaaattacgagaagagagcggcagcttgccgacaaagatgatctagaattcaagagcactcttgtgaaatactctccgttccaggttttgggacggttcgaaaaccctttcaatgaatacagaattcaaactgtatttgagttctttttcaatcgagtcgttgaagtgttccaaagaaatagaggtggtctaccgagatcgaaagagcaaatggacgagttgatgcctattcataaaccgacatgggtaaccaagggagttttggataactctcataatgaaattgaagtcgagattaaaccattttcttcagacgaaaaagaagtgaacaccgaacctgtcaaacggttatattgcacatggctaggtcaatcatgcagcgtgattatattggataaattgaagatacttacggatccaatgttttcgaaacatttaatacatcccacctttggcccacaacgaatcactgatatgccagcgaaaatcgaagatgtaccgacgccagacttgattttggtttctcacaaccatccagatcatttagacgaaaaaagtcttaaattttggggtgatgatcatccacagaaaccaatgtggattgttccaaaaggattagcttcttatatgataatgaacaatgtttccaatttcacggagttgtcatggtgggaaacttgccatgtgaagataaaaggtgcgcaagaagataccatttaccaaatatcctccacgccggcaatgcattggtcaggaagatctgtgttagatgcgaataggtcattatggtgttcgttcatagtacataagggtaacaaaccggtgttattccatgcgggagacactggttttgtgcatgatttatacaaaagaatcgttaaaaaatatgggagcggcgtacggctagctttgctcccctgtggtcaatattgccccgaatggcatcaaaggcctcgacatataaacccagcagaagtcatcaagatcatgaatgatttggatgcgcaaactgctcttggtatccactggggaacatttcttctgagtggggagtactttagagaacctaaagagaaactagagttcttatctgagtttaacgaattaaaagatagatgcttttgtcccgagttgggtgagactttagatttctcaaataatgtagaataaataatgaataggcaccgaaatatctttcaaaaagactgttcactcagtatctatcttagaaataaaatcttggtacacttcatcgtttactttgaaagtgtggtggcctatatgtgggaaagatttatcatgaacttcttgaacgtactgagacaaagcagaaacagcgtccttcttaaaatctgcgaacattttaacaaatttcggtttatgtccgggaagcatcccaagaacgtcagattgcaccaacacctggccactagtatctgggcctgcaccgataccaatggtgggaatgtgtaatttgtccgtgatgacagaagatatcttatgcggaatacattccaatacaataccgaaacatccgatctgttgcaaagtttgactaacgttgtacaacgccacagcatcagtgctctgttgaccaccctgggccttgtacccgcctagtgaatggactctttgtggagtcaatcctatatgccctatcactgatataccacgtctaaccaactctttgatatattctagcgagtaatcatcttgagacaatccacactctactttcacggcttgcactttgggattcaaatgtaacaactggaacgcgttaccgatcccatcagaaattgatctttcaaaggatccgaagggcatatcgacaacgacaaatgcaggacctggagcgcgacaaacagcaccaacatgatattgaaattcgtcaagagaaagctgagtagttgattcataccctaaagaacacatagcgacggagtcacctactaaaatcatatctgagttggcattctgtgcccagcttgctgttatatagtcatacgcagtaaccatcgaaatggggtttctacgatggtattttgccataatatccttaacggtaagctgatgaacagctttggcggttgctgcaaccgccgagctgttctgcagcgagtaccatctcctgcctatacaccgaatcataccgttgctccacatctcggctcatctcaactcatctcatcttagacacgttcacctatttgacaaattctgaaatcttcaatttcacatacttaagacaaggaaaaaatgcgtcaaaagttttctttttctttttttcacttgcctcccatagcacctcagcaaaagaacatacttccggttatcagtagcgtcggctgaaaactaaggtttggtcaagcgtcaacgagcttgtaagtgcccccatagtctagcaagtcgggataagcacgaggtattttttccggctcatgttgacgccggaatatatcccacagtagagtggactttaacactgtctgtattgtaatactagctttcccttcctacgctggtaggagtacgaaacagccactcttttccgttaagcgaatactttattctcttggttgccaggaactgaatgtagccggtttcctatttgttccgatacccacgctttatgcaagtaaaggctacaaatggaggtggggcagtacacaaacccccaccatacaaagactccgagcccagaaacccccacagaatcaagagaatacaaacaacatatcgcactatattcgcctatcccaagaccaacgggtttatcgtgatttatattgtaaagccaaaaaggtttagattttgttttttttacccagatttcggataaacctgcatgatttataagagccgtttcttgttaacgcgcatagagtccgcaaaaaaagaaagagaacaagaaaggacccgtaataggtcttctggacagttgactaagcgttttcttaactataacttcgcacttggcttctcatagaactggaaatttgtagctttacttctgtgtgtttgtgtctttattgtttctggttgcgatcctcgaattaacacgcacctatctagtttttgataaaagccccaacttatgtatacagagttaatctacgatggagccctcatttttcctacttccgttcctttactgtgtatgcattacaatttatccaccattctcgatagttttaaacccgttctttgtgttgtctttagacatgtggcataaatgccgtttttcggacctagtttgtactggcattccagtataccttatattgactaccatttagatcttttttttttttcatgccttctctatctctccgaggttcctttacaatgtagtgtagattatgtcactacacaagtattcggaggaccttctttttctaagatagtttattgagttgacagattacacaatccaacaagaacagataatccgtgagaaaataatagcgtagaagagacggaatagtatctaagtccctagaaatctctttcttgttactacaaaggaggttattgttacctcggctggagataagtgtgtacggcaccttacagagctctgtacgtatgagtaagggattcgagaaagatagatcaattttgtagttgatttttgaggtaatttatttcggtttattatcgattgctagttgttaatcttttcttaccggttttcgtctgttgaagcactctattattagctggagtattccatatgttcccgtagcctacatcaaaagggagtttcgttgctttgctgcgacgtcaaaaagttcacctcgatttaaagtgcctatatatatatatatatatatatatatgtgcatcgctctttgtcaaggtgcgatgacttgaggaattaaacattaaataagagtggttcccttattcaggaaaagattcaaaaaggaagtacaccttttcccaagcatacttgacagaacttaacatgtttttatctttgagaccttcattgagtgtttctcgtttggctgttgttagaagagcttactcttctccggcttctaaaaagcaaatcaacgatggattagtaccattgcctcataaggaagtcatcgatatggcttttgatttacatttacctgaaagatcagttattggtaaattgccataccatagcccggaaccaatcatctttttccatgggttgctaggttccaagcgtaattataaacatgattgcaagaaattggccaccgctttacaaacaccagtttacactgtcgacgtgagaaatcacggttcctccgaacatgctcttccttttaattacggtactttggtcaacgatttggttcatttcattcaccaacataagctgggtaaagttaatatcattggttattcgttgggcgctaaggtcggtatgttggcatgtttgaaacatccagaacttttcagtgctgcctgtatcatcgataacgctccagagccacaaccacacattaaggctttcctttccacgttgatcaaatcatgtgtgaaattgttagatcaaggtaaagttagagttgacgataaactgtggagacacaaggcttctgaatcattgaaacgttatctacctaacgctggtgttagaaactatgtcttgaataatatcgtccataacccaagagttgttgaatacagatctcccgtaatcaattacgatgatggcttaattcatttcaaaaacccagtgagacatatgttggattgtggtgtgaaagatgtagctgactggcctacagaagaggtaaaggataaaaaattcttaggcccagttaacttcattagagctaccaaatctgcattcatcaacccagatagtttgaaagcaattaatagctttttcccattcaacaacatacatgaaatcaatgccactcattttgtgttaaatgaacgtccacaggaatacttgagagctgttatcgatttcttcaaagtcactagatatcaattggaaaacaagagaaacaaggaccccaacaactatatgcaaacccaaaactccatctcaaactcggatacgatgggccaaagtttgtgaagaaccctttaatattttaaccataaacttcttttacaaatatttcaatctgtcatatttttcattctcttctaatcaaaccattctcaaatacgcaggacgtatatttggtaaatgttcgaaaacaattccaaatatccacttataaaccctttaagttagtctagtgcttgaattattgctatttcagaaaccttcgcaaaattatacatatacttatgtctacagaaatttttcgttttatgtgtaatcaaactatatactaacctttgatctgtttatctgacacgcgacagtttccttttgtaattttccctactactaacatcacatcaaagaattccccgtagagaataacaaaaagaactccgaaaaaatgaaactgaattaggtacctactgtatttaaacgatctcaagtagttccaaatcgatactagacgattagaatttatcattcccgtttacaagatgtgaatcattgaatcattggatatatattcgttaaaaatgttgttgtgttttagagtctacagtttatcaacaaccacggcattttaccatcaatagttatgtcaaaccaaacaggtgaacagtggacaccattcatactgagcacaatggtagcagatactatatcttcaatgataataacagaccttgacgatgatgtattgactgtaatagatccttttcaagattttttatctgatttttttggcgacgacagagatattgacgaaagaattgaaggtgaaactgtaatcgatgatgatagcattacagatttcgactcgacctcagtttggagtagtagcagaagcagtaacgattctgaatatactcatacatctaatacccgtccttacacaaggggagaaatacaaacatatggggactcttatggtagtaccaacattttttcatcgataccaaactttatttcgcttagccatactggcacactttccaatatatactggtaccctacacagtcagtaagttcaattcaggatgggatatatgatagtgacgaaggtgttgatgttaacagcagtgatcacgatggtgatattttagaacggcccagcaccccgtatgaatacgtatacgatgtcagggacccatccaacagggcagctcacttttcttcgattttggacatgaatattttcaatgcacacaatgataccaaggatggttaataatcaaggttcgtggatatcataagtggtctgcatttagtatttacattttaatatataccgcaaaatatataccaaagtgaagagtgcgttgttgttgccataactaatcatttcgatacaatgttgtattcatccaaagttgaagccgggactgtgcttgggctgccaacaactttgtcaacaccgctgatgctttttgggaaagcaattacatctctaatgctttcactgccacagagcattgcgcacattctgtcaaaaccaatggcgaatccagcatgaggaggtgttcccatcttgaaagcatttaacaaatgaccgaaaaggtcctcagggtttttgatattcaatatttcatggaaaatgtagttttgcaattcaggatcatggattctggtagaaccaccacctaactcaacaccattaacgacaagatcataatgttcaccatggcatgacaatggatcgctttcaagtttattatagtctctcaagttaaccatagtaaatggatgatgggtagaagaaaatgcattttcagtgtacactggatagtgactgcctttttccgcggtttcctcaactggggcaaataaggggaaatcgacaacccatgcagctaccgaagcatcagtcttacggaaaagttcttttcctcttttcgactgcgttattagttgacgggctctacctagtggagtaggattttcaaaaagccttctactaggttctctggtggagccgataataatgtcacctttccttaaattaaggaacttcgttatcaattttggattctcaaaagcagcaattggcaagaatttagtgaaccatgaggtacctaattcatctgattcaattggaacgacaatgggagctctatagttgtaattatccttgttagacaaataactccagtctctgtgaaattcctcaacggtttcaaaagctttgcgtaaaactatgacctcaaatactggaaattccttattcgtgtatccgtaagctttgaattcagaaagatccataagtttcaagtccggatacctaaggtctggtttgtcaataccgtattgagtcataacctgctggtacgttaaatttatgatcttttctgtacctgagactgggatgatcttacctgtcctatccaatgtatgaaggtcagtgccactagcgtggagcttattccatgtacttgtaattactttttcaactacctctctaacatctttcccagaagaaaatgccatttctaaatcgacttgggtgaattctggttgcctatcgcttctaagatcctcgtctcggaaacaacgtgcaacttgaaagtaacgattaacaccactggcaatgagtagttgtttgtattgctgtggactttgtggcaaagcatagaatgatgcctcgccgtcaattttgcctcttgttggcactaaaaattcacgcgctccttctggggttgatttgaacaataacggagtttcaacttcagtaaaatttagggaatctaatacggttcttacgttcttggatgcttcgtatcgtaactttaaattattctggtattttggcaatcttagctgtaaatatctgtactccggagggaacgctccatcatctgccttaaggtcctgtagttgagatggctttttattggcttgattcaacttctgtaattcgataatctttagctcgtattcgatattgactgttgactgctgtgtctgctttttttcggacaactctccgatgatttgaaccacatcttctacttgactctccttcaaaaaagattgcgaatcaacaagttgtatcttctccccgttaggatctcttaatgtaccaaagatcaagttcttacctactttcttcggttttgcatcaatccatccattcaatacaactttgttaggcttctgttgcaagatgctctgaattgtggatgtctccgacgagaatttgaacttatccctaactgtttcaaaagcaggcaactttcccaaccgtttactaacagtgctaaaatttcttatcctcaacattaatacaaaaacttcaaggaaacagtaccagcggactcacaagccttacttactcagttacttgctcaacgtagatgtccttgttctgcaaaacccagttgatctgctttatcagcgttttgtccgaatttttatgtttcgctttctcattgatatttttcagctactaatttgtttccataagtagtgccaatccgaactgaaattgaagagaatgtgactaatattgttacatttgatatttatcattatctaaggccgtatatgcagggattcatcagtgtactcggaacaaattacattcgccgtttagtgaaagggttgcaaccttgtcataggaagccgaaattgatattagcggtgaatttcgatgtttctcgtcgattttttgtaccaaattctttgaataaacattccagacgcacattgatcccgaatcatttccgctgatgactagtggatccttgccttgtgggtaaattagttcaagtccacagttatattttaatttcgctttcgtttcttgatgaggccatagaaaagttcgtacgactgttcctctcgtgtactcccatagtttgactacgttatctagagattttaccagcagaaactttccatttctactaaatttcacggtagagataggaacaacaccatcctctgcgatccaatccttgtcatacgtcaatgttttcaaacaatgacctgattctgtatcgaagattcgaatcaatccatcgtaagaaccggagctcaaaatgctagagtcaaatttggggatatcaatagaaacaacagcatcagaatgagcagacattgtctttaatgctgtaccacttaacacatgccattccttaatgctttcgtccatcgatgaggagcagagtatgtttcccttattattataacaaatggatattacaggcgcagtatgtcccatcaacctacggatccgaccataaatgatgtgggtgatttctacagtgaaatcttcggacccgctagctatacatttggaatcaggagaccagcagaggcaattgatacattccttatgtgttgtagtcaacttcatcattttcgatgatgaaatctcatatactagcatgtcagtgttctgacatattgcgatcaattcaccatctggtgagatctgacaagaagtactgatttttcctgatgcaggaagtacctgtttatcaaattgaagcatccttagggttagcgtgagatcagacaccgagtctaaatcacacatgaaggcacatctcttcaagaattcttagtattttagtatttttaaatgagaatttgaattggcgatttcagttagatgaggaaaatgtgtcagcgggaacaatacaggatgaaatagcctcaataggccttctacggaattgacaatacgctagttgatgggcattgaacctgtaagataaccctagtaatttacagtgctaggctacagtgatgtattaaacatggaaagaacaaaacccgcacaccacacactaaacacactcattctctttctattgccataaaataagttaaaagtggaaatcattccaaatagtttaagcatttatggacatacaaaccacagggaaataactttataacagacagtagagtaattcatagggtctaacacactgaatacagtagacagtaactaaatcccaggtaaacataatactgtcataagaaccatatccaagaatgccaatgaatatcgttccaagtccagatttcaagtctgctgttgccaccgataagggttgcgagcaccaatcgaatgcagtagcaagtttaccagatgtattccgtgaacaagtcggtgcccgccctctgaacactcaacttaatgacagacatccattagagtcgcgtgtacgcaactgggacgagacccagcacaaaaggcaattggaacaatatagacagattttcggtgttgccgaaccaatgaagagggtcatggaactgaaactagtacaaaacacagacttcaatcctctaaatcaatccaacttgcataaggatgttttaatgaacaaagaagcgtccattgactgggaggacgtttatccaacttccgatttcgcaagtggaatgatggtagcagacgatgtacacaccaagatagaaaagagaatggggatttaaacaattcttatgtttctatgtttcttcatttcatagttccatctcactgcaaactacacaattctgtaaacgtccatcgtatgtattttaatttagtcccataagaagttttcacattcgactatatacgaattgatactgtttctaagtggtaacacgccaatttcaataaaaaaaaagcaaaatgggtatctacccttgcaaaaaggtaagatatgaatgtaacatgccatttgcatctacaccgtcttgtttctcataacttacccctaagcttaatcagtctggtggttttcataaactgtgtgatatggctggcactgtaaaaaaaacttgagatctaaaatgaaagctcaaagagaaatagaagaaaaaatttatcccccagaacaaacctgtcacaacgaagaaagtggactcttagattttagaaaagtaaatcacacagccgcttccttcggtgacctagctactgaaaggtatcacagtatacaacgcaattcaattacccattagtttttgtgttccgtgtgatatttcccgtgtgaactctgtaagctgattttttactttcgctttgttcaatattatcaaagtggtaagcagtttttgattgaccaaccgattttgcactctctctgttttcctacaagcatcatttctttccttagcaatggactaccaacaatctcatcaagtcgactacattagtactgtcaattcagtaaattcgcagttgcaggactttggtataggatccactattggtagtgccaatcctatcagcgggtcgtcaactccgttaggtggtgtaccgcaaatacacaggtcagtttctctgatggatactttgggaatacaaagaactcaatctccattccataacgctcctgggaatgattctccaagcattttttctcagcagacttctattcattggaacatgaattccgggatcaatactggcggtggggagataccgttcaacgctgctgggcctggaaatgggatggcagcagggaccgggactggtgatattcatactccaatatcccgtccacctggcattattacgaacgtgcagcaaacttcgtggcagtacttggaccattcaaatcaagttcaagggcctttcgattctgaaataatggatcaatggtataatgctgggtttttcaacgaatctttgcatttaatgcctatgaatagtgatgatccctttcatttttctggtcgctttatcatgttcaatgatttattatcaaagaccgggatcatcaatccattccatgcgtttgatatgatttgtttcaaccatgcactcgcttctgctgctgcgccatcaaataatatgatgaactttggccaaaaggggagtagcacttccctgatgcagcagcatgtattgggccaatcgcaggcccatcctgccaatctgtctcaaagacaacccaagccattcgatcttcctgcatctaatactacgataagctcttcgtccactactccagtgccagtattacagaatatgatatctaaagggttgcacttcgacaataatacctatgcgaatattgacaggaacttccaatctccagatttatcccattctcaaattttgcagttgaaaaatgaggacggctcttactaccagaacactacagtttccgtaccgttttccaaacacgtacaggcagttgattcttttgaattgccattagaatctgtaagtgataaaagcactggttccttcgcagctaaatcggatacgtaccaattagcaccgcaaacatatcaaactacacaaccaattcgatcagttgatgcaacttccattaaagaccaatatcaaccgaccaatgctcaaacggaggcttccaactccactgccaacgatatattacagcagaatatcccggcgaaggaaccctccactgatcctactacaaactctgtatcggtcgaaaagtcaaaagaagcgcccgtaaaggctaagacggagaagaagttcaacgctgatgtcatccaacaattgattttggaggaagaactcgaacgtaagaaaaaggaagagaaaaagaagaagaaggaacaaaaacccaagaatatcgaggagaacagcaaagttaacaaccgcacgactagttctcaatcgaaatcagatgaaaagaaggaagcctcaccatggagtgctactcctaagcctgctgttcaaaccaagagcttatctgatattcagagaagagatgctgaagagaagagaaaacgagaagccgaacgtgagagaaaagaacgtgaagcagcgttgaaacttcaacatgcccttttggcagaggaacaaaagacaaagttcaatgtttcctccgtagcgagctgggcaaatccagttggaacgaaagctcctgctaaagcccctgttaaaactacttcacgatccactccagaaccatccgcggatagtatcaaatatatcgaagagcaacgtagaatcttggaagaaatacaaaactctcaaaacaagtcatctgcgtcacctagctccgattcttggtctacaattgctaaaaagaagacaagtttggactctccaagaccagcccctcagattaacaactcatttttgaaccctggcaacaccaagaagaaaattttgcacggctcttcaatttccatcccaactctgaaaaagggtgttacctcttctccaatcaattattcaggtaatcaatccacttctgcaaggaggcaatttttgagctggtgtagatctcaaatgaaactagcacctggtgttaaagtggattctgttttagagatgttactctctttaccaccaagcatggattccaaggaaatcatctctgatactatctacgctaacagttcagtgatggaaggtcgttcctttgcatcagaatttattaaaagacgtattgaatgcgagaaatcattgaatgatcctttaacatggtcagaagctcttgctcttccacagggaagcgctgatgattgggaattccaagttgtgagtaagaaaaaaggtaaaaggaactagtctctaaaacgtatggggtcagtagcatctagcattatattgttttttgtatagtgtacataatctctagcaaatacccagagagaaaactcaactgtatctacgtggtatcattactgaattagtttaccgttgtcatccaacttcaattggtatagtttttggaaaatgttctttctatctaaaatggaatcgtaacgtctttgtaaagcttggttgaaacagatttctctacatagattcacaaatgcttggggccaatctggttgtaatctttctgcttcttcgatgcaacttttcaattcaagatcaaccaatttcatttcgttttggtacctttgccaatacttatcatcaacggacccattcttatacaagatctcaatttgaacggcgacctctcttaatttaatggtacgtcttacagcttctgcaccacggttcaacagagcagctttaaccaccttagggtgaagttgttctgtttcagctaattctgcaattgcaaaatataaatcacgggcttcatgttcatcaaaaatgcttggtaattcagctagtttcttgacttgactcctcctatacttggatgcaaagatcattaaagatattaccaagatcgaaacataaactaacggtgtgtaaacgctgaccaccttgatttcaggcttctcttgcccttcgaaaaaagtctcgttgaaatgcgttccgttatctgacatttttgttcttttcttccaaagacgatcctggaaggtgtttcaatttaaacaacaatcaaatcgatatctcaacaggccacagttgacaattaccactcaacttacaactttcagaagatggtatgtgtttagatatagatgttacacttttcgtttttttcacttttttcttattttaatacgtatactgagtgatgttggaatcctcatttgacattaagcatttgcaattcctaaatctttgccactattagataaagaaagagcattgcgagttagaaagagtacaaacctctactttatagcggaaaaaaaagtgcattatagaacaagcgacattaccatgctattaagattgagatcaaaacttggtattcaccgtgtaagttgcgaaggaaatgacaattttggcagtgtgattgaaaaatgggcaaaccaattaagacttaatgtggatcctgactcagtttcagtaagtacacaacctggcgtctccaaactgatgactgagatagcacaccaaggtgtggaatcacttggcttgagacatggagacatggtgacagttgaattcaaggttttggacactgaagaaaagaatgtttcggagaaggaaatgaccaatatgactgtctccgcaagcacaacgagtgttcccatcagtagtagccacaacaagggatcaataagaggcaaagtcaaggaatctgctttagatatagaacttgagggtgagactggattgatacctcgttcaagatcatcactttgtagacatggagaaaagggaatgtgtgagtattgctcgccattgccgccttgggacaaaggctatcaagatgaacacagcatcaaacacatatcgttccatgcgtatttgaaacagctagacgaggttaccaacaaaaaatcctccggttcatcatacattccgcccctaagtgaacctaactatgagataaatttgaattgtgcgggtggtcatgagccgtggcccaaaggtatctgctccaaatgtcaaccctctgctattacactccaacagcaatcctttagaatggtagaccatgttgaatttcaggagagtgaattgattaaccaattcatcgactcttggagaaccactggtatgcaaagatttggttatttatacggttattataaaagatacgataacgttccattgggaataaaggcagtggtcgaggccatatgggaaccgccgcaacatgatgaacaagatggtcttaccatggatatggaccaagtcgttaaagaggtagaggacacggataaacttgcgcgcgaaatgggtttggaaaggataggtatgatattcactgatttgacggatactgggctgggagatggatctgtgtattgtaaaagacataaagattcatttttcctctcgtcacttgaagtgatcatggctgctaagcatcagttaagacaccccaacgtcagtaaatttagcgaaacaggattattctcatcgaggttcgtaacttgttgcatctcaggaaatttgaaccaagagattgatattgctacgtaccaagtaagcattgaagcggaaggcttagtggaagccgacctaatttctggatctacacatccctcacaagcatacattaacgaaacaaacgacaagagatacgtaccggaaatcttctacactcgtaaaaacgaatacaatcttaccgtcaagcaaaacgccaaacctgcattcccagtagactacctattggtatctttgactcatgggtttccaaaggagaccgatgatgacagtaccaccaccgcaaacaccaccacagtattcaaaactgtagcagggtttccatggaccaaccgccaagctatgggccaatctcaggactacactgaactaaagaggtacgtctacaaagcatgcaccggtaatgatctcgcagagctacaggcaaaactctccaatttccatttcctattgtacctgcattccatagaagtgttgaatcagcaggaatggtcgctcctcatcaggacagtgaccgcaccaacactgcatgaagcaactgaacctttactcaatctcatcaactccccaggatggcagaccttcgtcatgatccttgagcagtcaatgtaatgacgtgtgttttcacaacagggttcagccaggcctgcggtcaggtgagcgttttccatacccagagaaaatctcgaggcagttctagaaggttctcatcactatatacggatacatagcaaactaaatttttttttttttctagtttaaatgtacgaaacgttttgcgagagaaacttcagactaaagctttaattgtcaattccctctctgtaaagttttacatgaacttttaattgattgaaagagagactgtataaaggaagggagtgttctttgatctcatttagcttaaattgtaataaaattacagttatagtactttttcttaattatcgattatttcggagtggaaatagaacaaaagtaaacggataaactcttttgtaaaggatagttcgaaatcagcgcgatgagtattccattcggtttagatttaggtaataacaatgctgttttggctgttgccagaaacagaggtattgacgttgttgtgaacgaagtttccaaccgttctaccccagctctggtcagtttcggtcaaaagaacagatttgttggtgaatctggtaagaacaagcaaacatccaacattaagaacactgttgacaacttgaagagaatcattggtttggactacgaccacccagacttcaaggaagaaagcaagcacttttccgcaaagttggttaagctggatgatggtaagattggtacccaggtcagatttggtggtgaacaacaagtctattctgccactcaagtggtggcaatgttcattaacaaggtcaagtccaccgttattgaagagaccaagggtaacatcaccgatgttgctatcgctgttccaacctggtacactgaagaacaaaagtatgctatcgctgatgctgccagaattgctggtttgaacccagttagaatcgtcaacgacattactgctgctgctgtctcttacggtgttttcaagaccgatttaccagaaggtgaagaaaagccaagaattgttgcctttgttgatattggtcactcttcttatacctgctccattggtgctttcaagaaaggtgaattgaaggtcttgggtactgcttatgataagcactttggtggtagagacttcgatcatgccatcactgaacactttgccgatgaattcaagggtaagtacaaaatcgatatcagagaaaatgccaaggcttacaacagagtcttgagtgctgctgaaaagttgaagaaggtcttgtctgccaacaccgctgccccattaaacatcgaatctgtgatgaacgacgtcgatgtttcctctcaattgtccagagaagaattggaagaattggtttcttctttgttggaacgtgtcactgatccagtaaccaaggcattgaaacaagccaacttgactgctgaagatgttgacttcgttgaaatcatcggtggtaccactcgtattccttgtttgaaggatgctatctctaaggcattcaacaagccattgtctactactttgaatcaagatgaagctattgctaagggtgctgcttttgtctgtgctatccactctccaaccatgagagttcgtccatttaaatttgaagatgtccacccatactctgtgtcttactactgggacaagcaagttgaagatgaagatcatttagaagttttcccagctggttctacttacccatctactaagctgatcacattacaccgtaccggtgacttcactatcgaagccaaatacaccaacaaagcagaattaccagaagatgttccagtccaaatcgctaagtgggaagttaatggtgttcaactaaatgaaggtgaatcttccatcccagttaaactaaaattgagatgtgatccatccggtttgcacactgttgaagatgcttacactattcacgatattgaagttgaagaattagtcccaccaccagctgatgccccagagggtactgaaccagaatataagaaggtcaccaaaacagtgaagaaagattcattaactatcgtcgcacacacctttgcattggatgaaaagaccttgaacgaactgatcgaaaaggaaaatgaattatctgctcaagacaagctagttttcgaaacagaagatcgtaagaacaccttagaagaatacatctacactttgagaggaaagttagatgaagaatatgctccattcgcttcagatgaagaaaaggagaagctaagaaatatgttagctaaggctgaagaatggttgtacgatgatggttacgattccactaaaggtaaatacatcgctaagtatgaagaattagcctctatcggtaacgttatcagaggtagatacttggccaaggaagaagaaaagaagcaagctttgagagctaaacaagaatcctctagaatggctgaattggccgaaaagttagctgcccaaagaaaggctgctgctgaaagcaacgaggaaaaaccagccaatggtgaaggtgatgttgatatggattagattctttattgatctatcgtattactctaccctaactcttatatagatatttttgactatttttcttctaaattattttattctattgaattgaatgcataaatacacatataagtttatatattaaccatgttaaaaaccatctcatatttatgctttgataataacaggaatgaaatggggaccagtgcgtgaatgcaggagttgaattgtaaaaataataatgccatatacaagaagggattcattaaatgaacacaaagacaaaagaccaggctttccaaattcccaaaaggcttactgttcattattgctactagccgcaacctgtcgtctagcctctttctcaagtttcttcttcttttcaaattctgcaaaggctttgaagaatacaggtacatgttcccaaccctcactatcatccatgtctaaagcagcatccgaggcttgctctgtatcatggcttttcgcctttttcagagcattacgcttttttgcttctacaacagcctgtggcaatggtgtggtacgctttggaaatagactactcgtcggttgctttttcatcttctctaacttttccttctttttatgcaacgattttgggacatttttcatatccagttctttcaaaggtggatggaagtcggcaggccacacttcatcagtacctgatatagctttaactgcctctcttttttttgacttccaatctttcaaatcatcattgtataattcccaaacgcaattgacacaaccggacatgcaacagttgtctggttctatgggtttggacggtaccttgactccagctatctctctcatattctccgaggtcaaaaacctactagtagaacgtggaggctcgcccttaagtctacccccgaatacagatctcatcctttcctcctcacttccgtataccccctcggtgttgccctcaaaagtcatttgcactggcttggcagtaaatatatatctgacatttctcaaaggtggtgctatacgtatcatcacagcaatatagatcttatgcaggatactatcgacagcgttttgatacgcacttattgacgattgtcaatgttgatttgtgtattattctccgtgattattatcttgtctaaactttaaatgcttctcttcattgggattttttttttttttttagagtatcggttgccataatcggtgatgatgattaaaaagcatgaaaggaaggttcagaaaacaagatgagatagcagtcgtagatccttagcaccctatttgacagtacagtgatgtgagtatacatgtataaataaattgtgattacatgtatccagcaacattttacaaaactacgtagatatacatatatatatatatatatatgtggttacactctcgagctgtacttcgactgccaaaaacggagtttccacttgaccaacttcaggttagtatcttgaacgctcttcgtttccaagttcttctacgagtgaagcatgcaatcgaatcgttcgcacctaataaattccattttgcatcacagtattgccagctgccgggtacccaagtagattcaatccagatccaatcggaaggtagttcttcgtggaacttccatggtgttacagatggagtttgggtgaatgaattagagaagtgagctctttcgtaaggtagcaattttggggtccagccctcttgcttccattttctctcgttttcatcaacgttgtattcgatgatcttgacgtgtacgtaatcggattctggatcaatcttagttggatcctgaaggattaacatttgtagttgaacctgtagctcttggcccttcaagccttgtagagatttagggaatggaatgacttgactctcacaaatcaccttgtattgttgaaagttggtttccagtttggattccgatggtacgctgtcccatatataatagtaacatcgccttatccacaaatacctccataggagtttcatcgtgctctggtaatacactgaatggaacacggagacaaggctaatgacaagcactgagtatgttcgtacatccaaaaaactaacggtaattaaatgaattactgtcagaagagccactatcttaaaggtttgtgaattgatattagtaagttttcttaccttgtctgtaccgaggacttcattttgaaccgttttaagcttctcaagaacagagtccaaagtatgagtgatttcatctattgtgggtgcttcgctctgttcaagctctttccatagcgtataattgtaataaaacatagtgccagcaagaatgaatacgcttgtgtaccccaaccatatatcaaacgcttggaaaagtaaggaagtattcttcggtacaaccaacgctgttgagtaacatagcaatataatatatatcaactgtaaggaaacatcgtcaatatgccacataagtttatccaataactggtccagcagtaggagccaaggatataatctataaagacatgcaattgtaatgggctctaagtcttgtggtttatatgggggattaactgatttcgatttagaaacaaatctgacatgaagtttcttgttgctcatggtacatctgaacaatattgtatgcactaataaccgattttgagcttatccagacgccgttttcttttcttgccctttacttgttatttgcacaatcggtattgtaatctatatttccttttaattaaagtctctgattttgaattggcctgaagaagtgaacaagagaaacggcttttctaagaagacaagagaagcaatctgcttcgtgggcgttcgaaaaaaccttacaacaccacgttatgggaaatactaaggatttaaatcagttacgaagaaaacttccgacagtgaagacgttttctcatgataaaattaaaactacaatctacgtgaagagctcatcgccttacatttccgtggtgaaacgaaccaacaggtttctttccaacctgcatagacgtaaaagtgaatacattacactactgggcatgggtaaagctgttttcaaaactctatcagttgctgcacacttcaatacaatgggtgattacaaagttgacatattaacgaagacattagatgttttggatgaggtattcgctgatgatggtaaagatgaagatggaaatgaggtttcaacagaggacagggaaacggaactgacaaagcgtactttgagcggtgttgaagtgcgtataagtcctgtataattgcgtaatcaatattagtatgggaagcgcacattaatatagagttacatagatatttcagtgtagacatatcaaatactagcgggacggttgcaattccaaccttgcttttgacttttcgatcatgtatctgagttcttctaactctctgcgtatcttgtttttcttattgaacggctcgaacttatgcaataacggctctgatacttttaaacacttcatgtaatctctttcgtaataatatttctgagcataagagaccattttctgtcgtacttgcttcaatgcatagtcaaaactctcatcttcaatcaacagatcaaaatcttccatcttcaaggcatcttcctcagttctcgttggacctttctcctccaagaaatactgtctaagttgttccttatattcttccgcgctctgacctcttcttactttcgttttacctgttgttttcctaaccagtacctctcctgtattactatcgatggtgatcggttttgtcaatgcttggttccttctaccaccctttgtaaggtccgcattatcacttggagtcacaaccgattttgaaccagccgaagcaatgtgaaggccagaaaaactcgaaaccagttctgacattcttcgaagcataacactgtatcacttctcttgcctcagatgcacttcaacggtttcatgcacactgcttcctttacacttgcgatttgatgcgatgtggactgaaattactcattctttttttttttttcagtcaaagctatgacgatgaacttaaataagatgtagaacatatatatatctcagtagtacagattcaaggacagttgactatcgtagaaacgctcttctaaatcatactgaagctgattatggtcgtgtaactcatttattattactgtaaagtcgaggtactcttcttcaccaaccactatcatgggggcatgccagactccagcaccgtaagtaacagcttggtttgatttacataaaaatgcttgtagtgtaagtaaatcaggttcaccgtttttgtcgggtaatgcggtcaccacaagataagcatatccgcttttgatatctctgcccatgggaatgaaagtttgagtagagaacggatgtttctctagaactttgatttcatgctgatacttttttaaagaaccgtcggaatcaactaaagcgaatcttttctgtagagcgcctttgggaaagcaccggaataggttacaacttggattcttgacttttaaactctgagggaactggttctctatatggctgacttgtaatagcttaatggcagttccctggttggcattcttttgagatgagtcaagccttctgacttcttcatctggagacacaattgaaccgaattcctcaaaagcagtaatagataagggaacgacaggtatacattgcattgttaattgggtaaggcaccatatatcgaccgcctggcgttacacatttaaaatacaccgcgctcaaaacttcttcctattcccattgaaatacagttacatatatataatatatagctcgcgctaaactttcttacttttgattagcaaccacaactgtgattgatgacattactgtcggtcaattccgttaccaatacacttacagtgaaaaaaaaaagcatactacagcagcccactactgacagtaatacatctaatcaaactttcgtactactttagatactatgtgtatatagttttgagacgaagtagtgtctggtcaacgcatcatcggcatttagatctttatcttgacttatagttcaattttatgtaactgaaccaattccaagatttttaaagtatcttcttataaacacaacccaatttatgatcaatactagtcataaggaaaaaactagacaaaaccagaattcaagagtctgtcacttgttcattattatcagtgtataccatacctagtgtctcatcaaacattctggacttctttttggaccaccttcttcgacaagactcattgggattcatctaatacaaggcgaacacagattcaaaatgataggtacagacgagcaaattgctaagtggaaacatgaaaaaaccatcggtatcattggattaggtgatatgggacttctatatgctactaggttttccaaagctggttggcgggttatttgctgcgatagaccagaattttacgaagaattgaaagaaaagtattcctcagaaagcttcaatgttgttgagaatggtacactagtgtcaagagctagtgattatatcatttattcagtcgaggccgagaatatcgaaaatattgtgaagatgtatggcgcagcgtcaaaggtaggctcgattgtcggaggacaaaccagttgcaagaatgcggaaatcaacgctttcgagaaatatttaccttcggactgtgagattgtatctgtacactcattgcatggtcccaaggtcaatacagaaggacagccgttagtcctaataaaccatagaactaaatctcaggaatcatttgacttggtagaatctttgatgtcttgtttgaagagccaacatgtttatttatcttacgaggaacatgataaaattactgcagatacccaagcagtaacgcacgcagcattcttaagtatgggggttgcttggtataagatacgaatctacccatggacgcttggagtcaataagtggcatggaagtctagagaatgtcaaagtgaatatctccttaagaatctattctaataaatggcatgtatatgcggggttagccttaacaaaccctgctgctcataaacaaatcacacaatacgctaaaagtgctaccgagctttttacccttttcgtggaagggaagaaagatgaacttactaaaagacttcaagtcgccaaagattttgtatttggtaaccacaatggcttgttactattacacgatctagctcttgatgattactcattatcaaaacatgaaaaaggtgaagataacgaagtgataccaaactctcatttatctctattagcaattgtcgatagttggtaccaattgggaattgatccctacgatcatatgatctgcagtactcctttattcagaattttcttgggggttagcgaatacttattcctaacagatggtttactagaacagactatcgatgctgcgattaacgtaccagagttcagagcggatgatatggaattcgtcatagctgcaaggtcgtggtctaatatcgtctcttttggtaacttcgaactctataagagacaatttgaagaggtacaacaatttttcactccaatgtttccagaagcaaatgctattggcaacgaaatgattaagactattcttgagcattcaaaaagtaaaaatttatgatatgtttacgcttgatagattatgttatatatgtatatatatgatatacaatgatatacataagtactgtgagagaaatttattgctaaaacttcgatacgatcggaagataaatcctcacataatgtgccataaactatatagacgccatgcattaaattagaaggatgatgaaaatagcttcattggatggaaaggtgactaacttaatagtttcagagaaagttttattttatcgcctgcgttttctactttctaaaaagtcacaatcttcagaggtttccaagttgttgagattcggttctgtgagtggactcacactcataaaagagctcaacccggttctttgcctctttcccctgtataactgttccgaacagtcttcgtttgttatgtggttatgggtatctaccggggttgggcttttactatgcaatttcggggagtttctttttgtatgattaggttgtgactgagcctgcgtttgcaaatattcgtttaccatctgaacgtctgtttgagtcaccgagtaagactcgaatagtcgcggggagaaattcttgaactcctttaccataattctgttccaagccatggccaattttttatgataatcggtgatattagtacagcgactataaattgatgataacaaatgctcataaaaggagcacaacccatagttcagaagaacaggagagagatgattcaagcagatagtcttattcacaggtatgcagggattaggtgtcaaacagtttaatagtatgataggctcccattcgttcataggcttgtggcttatgaaaacaacacagtaaagttccaaatctcggctttcgtcatgtagtactatattccagaactgcaaatttgattcttgtggcttgatatggcatgtagagtgcttataatggctcaaacgtttccattccctaaggagtttcctgtacaacggatgcatcttatgtggatgtggcctgctatttgaaagaaaaaaaagtagtgaagaataacaattataggcaatggaaaagcctttccaataatgatatattaccacacttagttggcaatatagtagttaagatatccaataataatcacgttacccttagctttgcatgcaaaggtatgcagtcttactgttttgtatttttacaaatcagattaatatattctattattatttttctctgattatcatttttgatctacaaattcttcatatattgtagaatatgtttatacagatagaagaagaaagaaaattcagagcattaatcagtaccggtatgcctcatgtgagctctctgcagttacaaactcgcatatataaaaaattgagattgaacaaaaaaatacagcgaggacaatgtgaacgatacagactatatacgcaagtaatttttactatgtctaatggggtctctttgtttgttgttacccggccactaaaaggccaactacaattttagtgaaaggaaaatctcaggatcgagtgattaataacacactgcattggttaggagttatgatttcattgtatttaatatttcactcattacaaagacattatctgatcttatagtacgaatacaataaaattgtttacacatcaggagacaaacttaccgctgtctggatcgctgtttattcgtttatttgtttcgaattttggctgtaactggttctcaaataagaaatattttgaacaagtacttcctaattttacatatcaactagtacaaaagttttggttttaaattattaattgacttattaatacaccttttctttaattaccaactacctttgaattgaccgcagtacagcaattacttataaaatatcacaatgggtaacttctttagttctatgtttgatagactattgggtgcggaaaaagaattacgtatattgatattagggcttgatggtgctggtaagacgacgatattgtacagactacagataggagaagtgataactacaaaacctaccattggtttcaatgtagagacgttaaattataaaaacttgaaacttaacgtgtgggatctaggtggacaaacttcgattagaccatactggcgttgttattacgcaaacacagcagcagttatcttcgttgttgactctacagataaggaccgtatgaatatagcttcgaaggaattgcacctcatgttgcaagaagaagaattgcaggactccgctctgctcgtatttgccaataaacaagatcaaccaggcgcattaagtgcgtcagaagtatcaaaggagttgaacttggcagaattgaaggatagaagctggagtattgttgcatccagtgccattaagggcgaagggataactgaaggtttggattggttaattgacgtgattaaggaagaacaaatgtaattgtagaaggaattgaaaactgcatgttttttagtgcttccggtcccattatatttatctacaactgaaatgcttttttaatttgacatgacctaagatagtaataaaaataaatgacaaagctaataacaaagttaaaattcgaattgtttacttcctgccgatgctggcgtaatgtcctattgaattcctttacacgcttatttcaatagacattcaattttcccatgcatttttatttcatctccaaaatcctccactatttcgtttacgtttgcgtatgcgtgatataatgttttctcctattcaaaccattccatcgtgccctagtttcattatatatatagcatattcataattcgcataattaagcagtcattataccatgcaaccacgaatcctttaaatggaacatggtcttgccaactaccaccatatcattcagtatatgatgtattacttcgctcaacgtaaaaaggtaaatctctttgttatatattacaggtgtacattaccccctcgacgaatatcatatactggaaacaaataccaaaagcggtacctctttttgattattatttgctatagtaataactacaggcatatagcaaaaaaaaaagtaaccgttataaagatcgtgaattgaaaaaaaagtgtgtgttattaaaacgatgacaacttataaaaaggtcaagggaggcaaataactcaggcctgtttatcattcatgttataagtatatgaattggtacacttaggtttgaggttttgtcaattggtcttttcagtataaactccgatttgtcattttcagattatctttaattttgagactgtccagttcataggtgggtgtaaaacttagtccaatgaggttttactttaatgcgttccgctctagagtgaactccagggtgtttttcctcaaaggtttaagaattacaccgtttcttctgtcgcctatagtcccactttcgatgcaatggtttagaggaccgttattgaacaattcaacggcgctaatacccgataaaaaaggggatactttcgagatgggcttatacatttcttcacagaagcaattacaggaagaagccgaaaaagagcgtgaaagaattataactactagtgttatgcccagtttttttaagaggattttgtatcgcatcaatgatgttattatagaaccggttttaacattgcttcgatttctagaactttcatccatattcattccgttgttaataatatatccaattacatgccttggacatcataaaacgctaaaggttgattcgaatagagttgtgaaggagacatcaggttcccttttgtggtttaaacttctaagaaaggctttagaattcgctggtcctacattcataaaattaggtcaatgggcaggatcccgtactgatattttctccgagggtttatgcgcagagttggggcgcctacacagcaatgctaaacctcatgcgttgaaatttacaaaagaagccattgttaattccttagataggaaatatgagttcgatgatatatttgatgaatttaacgaaaaacctgttggatgtggtgccatcgcccaggtctacataggaaagttaactgaattaatgatgaagaactttgatattaaaacggatagtaggtattttgcagtgaaagtggttcatccaaacgtaccgaaaaagatagaccgtgatttaaaaataatgactttcttcgccgatatgatcgactctgtacccaccatggaatggttgtccttaccaaatgaagtggagcagttttccatattgatgaagttgcaacttgacctacgtatagaatgtcagaacttgcagaagttcaatgataattttgctgacaatccaagagtaaagttcccagtcggcgctatggatttatcttctcgttatgtactttttgaagagtatattcacggattcccaatggagaaatttttatcgagtaaagatggtttaaagagagtcgacctttgtagaaaagtcagcgatccatttatcgaggcttttttgaaaatgttgattctggatgatttcattcatgcagatttgcatccggggaatgtcatgattcgtttcatgaaattgaataaacaagaaacaaaggtagtatcttctgaaaaagaaatgtttcaaattgtgcacaagttaagagcaatgtcaagagacaacgaccctgaattcattccggagatgaagagagtatttgaggaatatgagcctcaggtatgcttaattgatgcaggacttgttaccgagttgaacgatcgcaatagagtgaattttattgcactatttaatgcgttggccaaatttgacggttatcgagcaggtgagctaatgatcgaacgttcacgtacaccagaaactgcgatagacaaagatttatttgcattgaaagtggaaaaattagtcaataaagttaagaagcaaacattcactttgggcactgtgtcaataggagaacttttggataaaatgctaggaatggtaagacagcatcacgtaagaatggaaggtgatttcgtatctgtcattgttgctattctattgttagaaggaataggtagacagcttgatcctgaaatggatctctttgcaaggttcgtattatttgtcttaatgaatggattttcatccacttgaagctcttggtctcaatttactaacaccaaaattttacccatataccggaaaaatattgttcatattttcattgctatgtagactatgagcgatgcgttttttcccggtgctcgtgtatttattcagctcactaccatttttacgtaagttcggaatgagcagagctcatgatttagccggcggtgattccagcatgctacaggatatgagttcgctatcgatgttaaagatatggctagggttagaaattcgtcaattgatgagcatctcttcaaaacagatatacgaactagtaaaaacggatcaattgtgtccaaattactaagaaaaaatggtaataaatggagaatattccaattctcttaatgcataacgaggataaacttccaaacaataacagttttgttgtataaaagaaataatttacctgacaactctgataaacctaccataagttgattagttcaagaaaaaatatagctaacgacccctaaaatagtcaccaataacagcggtgaaaaataaatataccagggattaattaaaaagagccctagctgaagcccatcatgacatatttcaagattacttttcataatgcatgaattctcgtttcccgtagttggatccaaattccgaagtatttaactgtcaaacaacaataatgacgcagaaagcaatcgatcttttgcagagacgttccttttttcctaaagatttccgtgaaatctctcgggaatatgccacgtcttatcgtctaactcaccatcggcgactgtctctcagtttgattcgagtaagcaaggcgcggaaggcatgaaaaaactggtaagtatttactatttattacattccttatgtcagcgtgtattaaatcgtatttcttgcgatcatctttgcgttctacaagacatcaacaaactctctttcacccaatagagtgagagaaagttattatttttctctgaacatggtttaatgtgtgtcaatcttgctcatcctcatgatacgtctacttttcacaatctgtggagaagcgagattcttgttaaaaaccaaacactgatccgccctcagcgaatttcagtttcaaaaaacatcttcaaataggcattagtgtagcgttttgaattttgcaatacaatttagtgattcctcaagcagcctccgtctgctcctgggaaactccatcccgaacacgctatacaatgtcacggctatctctaatgttatgacacaagatatgtccgaaaagtcgtaaagtcgaaaaaaaggaacgttctttttttgactttatcttatgatgtggaagataccgcactgcagtcaaaaaatgacacccttttttgaattttttcttgggtaaacggctctaccagataactcgttacggacttcaggtagtcaaattattaaacagctgagcgcatgtgcataacatcttaaataactttcaaatccaccttcttctatcgtttctaaagggtaaatcagcataaaatttttaattgccaagatgtgcccatccgcacattacatttagtttgatcagtttcacaatagaccaggagagaggaaataatagaaaaaagaatcaagcggtatacactttcagctgtgtgttgaaccaatattcaaaccaatggtaattcctctaagactgccaaatgttggatctacgtataggtaacggcatagaaggcaattaattatattgcactgactttgaatggttgtgtacaattatttaggaaattataacataatgccctgcataccgctggcgtgatagacaacgtcaaagggctcatttcagctccattcccagaaaacacttttgccaaggtagctgcaccaaatcttctacagaaagttcttcagctgcctgtcatatactgaaaattttttctgtctacaatctcctgctgcggtaaacacctgctgaaaaagtacctagaaaaatggggtgtttctcgatacttagtagccccacgctgcacaactatcgggacagactaaggacggagagagaaaaaaaaggtttcaattcgaaggtatatcgagttgaagccttagtgagagacctcctatcgttttataccggtccctatgatttattattctcttgttgtatttatttcttttaattcattgaatcagcttttgccaatagaggtagaaagttcattttatatgcacctaccactttctatggacagcgttgctgataagctgttatgcaatgtgaattttttactctcggcaaatgctccatcgacgaatgagtgacgtataacatttttatttttcgttcaagtgatgtggaagaggagacgcatattgcagaaaaactggtaggaattgcctaccgaaattgtaggcagcaggctggaagatgattgggagatttcaaggagtggggcgtaaaatagagacacacttgcactatattctctttccttttccgattaagatttctcattcctacgattctaaacaatgtttcttttaaactgttaactggaaagtgataacttgagtggtagctcatgatttcggtcaaagaaagaggtgagaagttcagatgtgttcatcagcctctaccatactgcatgtttcttttcctttctgaatgaaatgcgtctcttgtggtttcctgcgtgttgtcggcattctgtatttaagcaatgcatgttaatcactttctcccaatctgaactcatcggcgaaccttcaattactcgttcagatttttttcacgtatgaaatccaagccaagccaagttaaggtttgagacatctggaaaagtttcttatcttttgccattacagttttacttttcgagtaagcatttttattctggtttgtataacatattaatgtctgccgaggaaaagatcagagaagttgagaccggtttcacaaaaccggtggataccatttcagattcggttgaattgaatttcgaacatgataccgagaagaacttgctgaaagtgaatcgatagaatccaacgatgaacctaaggaagaaattattcaaaccagaggtgtcaccagaattgaggcggttaagaaacggatgcatggttcgtacttctggttgtttgctatctccatcttcttgacttcttttattctagccttagatgccaccacaacttactcatatcaaccatatgccacttcttcgttcaacagacactctatggtgtctaccttgaccattgctaattccgttattggtgctgtttgtcaaccgttcatcgccaagatttctgatatcagctcaagaccaactacttatgccgtagtcctcgtgttatatgtcattggttttattatcacggcttgttcgccaacaattgccgcatatgttattggatctgttttcattgctatcggacaatctggattgagtttgatgaactctattgttgtggccgatatgactaagttgaaatggagatctttatttacgtcattcttatccgttccatacttggttacaacctggatctctggttacctaacccaacatttcattagtaccaactggagatggggttatggtatgttcgctattcttactcctgctgtgttgacacccgctataataatgatctcttggttagatcggaaggccaataagagtggagaaacaccaattggtgttgatccactagccgagaagaaaaggttgatcaaacaatctgaaatcgatggtttaagagcttggttgattctgttaaagggtgctcttattgaaattgatgcctttggtttagtattgcttggtttcgccttttctttgatgttgattccatgctctttatactcatatgctgttgggggttggaataacccaagtatgatagcaatggaggtagttggtggtattttgctgatttgttacgcggtttatgaaatctggtttgccccattcccattgctaccaaagagagtcttaactaacagaacattcatttgctgtgtcataattgatttcatctaccaaatgggtggttacttctctctattgtacttcacctcgtatactagtgttgtattaaacttgtctatccaagactagacttatttgtccaacacgaccacgatgggtttgtgtttctttggtgttttctggggtgcgttgtttagagttttccgccgttacaaaatattccaagttaccggtattgccattaaattgattggtatgggtctatatgtgttgtgttctacgaaggaagatggtccacatttaggtctcgtcgttgctgcacttattattacatgttttggtgatgccgctaatgttatgggcacacaggtggccgcacaagctgcagttccacatcaagacatggctgctacaatctctgtgttatcactatacagttccatcggtgccgcagtgggctccgccatcacctctgctgtttggactgatcacttaccaaaagcattgtacaaatatattcctgatgaggcatctgcagctgccgcttttgaggatttggcagatatcactgcccaaccatggggtactccaacaagacttgccgcaattcatgcttatcaagacgttttgtacactctcttctgtatgggtgtcggtgttagttccatcatgttcatcgcttgtttattccaaactaatttctatttgggcgatcaattaaactgtgttgagggtgaacaagttgaagactacaatcataatcccgatggctctaagaagactctgctagacagaattgcggatttctggaataaaccgttgttttgatcatttttccgtattccatcacatggaagactttctctccttgatcgacttggagatttatatttgtaaattgttttaatttttaatcatcttatttctgttcatacgctttctctgtcggaaagctctggctcttatatttacagttgtttgcattcctgtcactagtttcagaaaagagttcttgaggtgaaagttgttcatatctctacaaaattatactaacaaagtagggtttggacgaacaattggcagaatcaaacattccttcatttttcatgtttcgtttctccgtcttcagtagtggcgatactcaaaacaagaaaaaaaaaaaagacgttttcttcgaatgaaacgagttattggttgatgcctagccagcagctgcaattcaaattagatataatcgttgaaaaccactcaatccaaatttttaggtatcagagagttaaacaaaagtcagtaaccttggtacattattccccgtaaaaagggacctctctatgcggatgagatttaaagccgaatatacccccccttttatttcttttagtagagtaatgcaagaaaaaaactgcatgataagttaaactgtgcaggaatatcgtgtggtatttatgcagtcaataaaaccctggatattttcttccaaaattcagtattggtaaacacctcattctttgagcacttttcgactgattacttaattcactatcggtattagaacatttatttatgccagttcgacgtcaatgacattgcaagaatactattatttttgcctttatgtatgctattgatgcaaacagtacctgatagaagtatgtataaaattgatttcagaaccatattctcgagcagtattcacagagttcatcaagttgaaaactattagttatgaagtaacaatagcccatgcacttagcatagaatgaacaaaatagccaatacgaaaagtgactaaacctaagggaagatgtacttttccattcgacttatttcagcgatgactccttcgtattttcttgtaatagaaaggttctaaaagaattcaaatgcaattatgttacacatacttcttctattacgaagctacattggtaaatttaaattcttatcaaacaatcattgcaattaacagagagaagaaacaaccgtgagaatatgaaaagtttgcaacagcggcgtttttacttgatgactttgaagatgaaacttctgaagctgttgctgcagaagcagatgaagcggctgacgaatcaaatgtttgacttcccaataaagagtaggaagaagttgattcgacagagtcacctttatagtcgctaacagcggtatcgtcatcgccaatggccttaatctggatcggaattacatcatcacgacctgctgcagcattgattgagccaagaacataaattccatcttttccagatggtacagcatggaaatcctcgccgtatagcttcaaaatacctttctcaatggtgaatggataagcgatttcaaagcttgaagaatcggcttccaatgacaggtagtttttaccgatacctataacttttccatcatccatttctaaggacccattagataaaacaatccctttagcagtttcagtgacattagcgatgtatatttttttatcgtcaccaatataaatgtgtccatcaaacaaggcagttcctggcgcataacattccaaagtgaaattggaagaatccgcggcggcaaattgcagcaatccaaacacaaacacactgaaaaaggttactaaaaatttcataatgagccgtttgatcaagagtcagatggtggaaaagagaatcgaattataaataatataccaagacatgtgtattgatcaaatgtcttagctcaaactatcattgcttgctagaagaacatttcaaagtatgctccatatataatatataaaaatcaatgaagaaaaaagccgctttatcgacgatacttggtgaaaatattgtgtaatgatcaaaatatgccactagtttctatcatttttgtttgacttcatcccatgctatattcttgccgtttttttctttttttcgaatgactgttaaatttgctccgcaaatgaatctcagagtgcttgcaattgtggtttggtaactccgtcagatccagatttacgtcagttagaaagctgcaaagatctaactctcgtaatttttagtatatcgcttatagttcgagcatactacctcatagctgaacatgaaaattatgctcgcgtataattgtgtaccgttcgagggacttcaagttgctcaaatttactcatgaagaagtgtttttttttttttgttttgttgcattatttacccttttacacgacagaattctaacccaccagaccaaactgttctatttagaaagactgcataggagaaaatgaggtacgaatgaaagagtaaatttcgtaatgttctcaattagtgaagatgttacctgtggagaataccattcttcaggaaaagacgtattaaaagaaaattggtagctatttaatatgaattacaccagtggctttttagcgtgctatctgctcaatgtcagttttcactaaattatgctcacattttatgttctaggagagaataagttaaaaaatttactgtcataaaaatgctctttactaacatcaattgaaccgtgaatattttaatctctctttgactgacccaagtgctacttaattcgacaggtattttcacccctgtaataggtttgttcaatgattggctctctaactttttgataaacaacgagtaaagaccacatcaagaaattgagattcttagggtgaggttgctattgaaatctttattcatttaaattatctttataagaaacgtttaaattcaataatgaatactgaatttttaatgttcagttgttgttttcctatgtgaggtacgtgattcatgagttacactctcaaatttaagaacaatttttaattgataatccattgtttcgtattgtggtgctatttcttatatcttaactgttacaggcttggtccgaacgactaactactctgttttttttttgttacagcttttgatatcacgtcaataacatgtcaaaatcaaaatacagtttcttggctactgtgttacctgaagaagaacaatcagacacttacattattcctccaacaggctgtttgagcggtcatagtaccacagagcgttatcaaaatgaagaaaatgtgctgcatgatagaaacatcagaaatgtagagaatgcctggtttgaggattcttatgaaaggaatttacaactcaaatggtaccaaagaccctcgaaaagggttctttacttgattctgactttgcacacactaacttttactatgttaatgggtccactagttattttaatgctacaaaatatatgcacattggaaacagtgcctatggtacaccaccatggaggtggcggtatgagcatgggcggtaaaatgaaacgtatggttatgggagataacgggatgggttctgtcagtggctgtaagaacaaaaactctcaaagtgatctttcggatgttcaatcaatattatctttcatatcaggtattttaggattctttttgtccggaaaatacggtcaattaagtgatagatttggaagggtgttcatctttaagatatttagtatgattaacttagcacattcaatatgcttgataatttattttcagttcttcaaaacataccacaaattttggatggttattcttttatctgttggttatttctctgggggaatcatgactctgatatctaatggaaacagctatcttaacgacatagttaaatcagaagataggacaatctcaattagtgttttgatgagtatgatttactctgcgctaggcattgggccacttttgggatcattcatagtcaagagatcgaataatgataatatgattccattatttgtgtcagttgcattggctactttaagcagcatattgactttttctattttaaaggaaagtaaacacgctgatgctataaacttggcacgccagatgtataacaataaaactacgaaaaagtaccacactaacccaatagcaaacgttctactgagttcgttagaggttttttggagttttttaagaccaataaaaagattatggctagccagagaaccaagcggctccattttaccaagagttagtgttctgactcttattttgattgataatttcaatatggcagttacagttggtatgatgaatccgttgattttattttccatctggaaatacaagtggacaagcgtggaaattggttactatatgagtatcggcggttttggaaaaactttcgttcttcttgcatttgcccctgtctttttcagatttttacagacgggacttggactaaggattgattcacgctgtgtcgacaagatagacaaaatttctcttttttcatcgttattcttcgtctttttatccctcctcatacttgtttgtgtgaatagctctactggtgtttatatcagtggtgtgttacaaagtttaagtggaatgatatcaccggttacgcaaagtgcgattgcaaaatatagttctaaaactgacgctggcgaaatgttcggcgccatagcattaataagacatttagggatgcttttattccctatattgttcctacaaatttactcacacacaatcgagtttagtgccaagttttttttatatcttccattattcgtttcagtggcaacatttttatcaagtgtcctcgggttgcgatcgtacacacaacttgaagaattagaggtgccagaagatgggcaacaacagaactcaaacaaaagttcagaattactgtaaatatttgatcccttattttcgtgctcccacaacaatttttaactattcaactactgtctacttctcatatgtataaatgaaagcatcaataacaaacactcaaactactatctaggatttcgaagtatcctatctgaataaaatcgactcatgcccttatcaaaaagtatttaggatgcattgataatatggaagatctttaataaaagcttctctaatattctgagcatgatgtaataattatattcgaattgcttataggatctttactgtatacaataagggagttaacaaagtaatgttgaatatatatcaaaacagaacataagcactaaaggaaaagaagagtacagccaataattcggttttgttgagaagtttagatgcactactgccgttgacggtaaatttattaactttctttccgtctgagtcaacacacttgaccttagttgtgtgcaccgaatccaatgttgaaacagcattattagaagccaaaatccatatgtctgtctgaccgcttggaatggccttgaattctttttctccatacagcgtcaaatatccatccccattgatagcaaatggcgtagcgtattgggtatagttagtggttaaagttagatagttcttgtttatcccaatgaactctccagtgcccaatttcaaggacccatcctcttgaattgtaccttctatgatatcaccggaatgtttaccaataaaaagcgagcttccgtcttcataaatcatcattccttttaattcgtttggtccagtaagcttaagaccgaatttttcagaagctgcatagacagtagttagccatagagttgcgaccaacgcaaaatagtattctaatctcatttaattaatgtatggggatattccgtaccgacagagttgcaggacaggagttgggcgatgaagggatgaattgcacagaaaagtgaatgaatgaacgaaaacaaaaatttactactcaaaattaacaggaagtaaatggtgtctcttttaatgaatgcatataagatcttcaattcaattaacgtttatatatcaccaatagtacaataaacattggcaaagggttctactggagcggatgatatttttcaaatacgattaaacccagtgatagaatttcacttcccatattttgagaagtaaatcagtacctaataataataccgggaagccgctgtagtaattagtgatgggtaatattactcttataggtggtcgattgggcataattgaaaataccaaacacatactttattgctcacagcgattttttgagtaacacaattctgtgaataccctatcaccaattggatttaccgaagcttgacaccctaacgctagaagacaacgagcaattgatacgcattctcgacccttagaggtttgaatcccttgatgtagttccaattttctcatttttagtaactcaaacttttatctccattttggaatttgctcactttgtatgtcgaagatctaaagaaatcttacaggaaaataaagtagaatagtgggaaaaacgggacaatagtaaaccagaattattcgatgaaattcatgaagaatatgcagagtgcgagttggtaatgagttcatttggcagttttattgctctaaaagtcctctattattgctattttctcttaatatttgtcatttgcaattaaccatgagtattatgcccgagtttagtatcccattctgtaagaccaattgcggtgagcaagttttactcggccagaactttatctgaatggcttcttctacatgcgtaaaatagtgtagcttctaaaatgaacttgcgtccatgtaggactaattgggcattctcagatattttttttacctaacattgatcgaagaaagccaataaacgatggtatatataccctgcaatacaaggcatgtttctataccacaacgtaaccgaatagtacttttttttgcaaattctgaaagtgctacaagttttgctatattacctgcgtggaaagaccatagctaaagaataataattattcatttcactcatttaataactactgtgcacaatatgaaaattgccatcacttcatctgttttcgcggtttcgttctttgctcggttaattactgctgcttcggcaacatttagcttgaaagtggatgcaccagacactaaagtcgatggtttcaatgtttaccttgactctgattacagagtcatgttagcaaaaactgatcaatctctcagtgccacgatccaggatgatggtacattgttattggacgatggtaaaactatgggtatcggcagaaattatttatctgcaaaagccatatctagcgcttggattgtggctgaaccatgggcaattgaaggaggtaagctaacgttgtatggtggcaacttccactctgtctactcccgttctgatgatgtatatgtgttaggttccagtaatgctgctgctggtcgtcctgacatgattgaagtcaatatcatcccattaaactctgagggtaatgttgtggcagactactctgctggatcagtgtcctcttctttagcagcttcttcagcaaccactgtttcctcttttttaagctcaactacttcagttattacgagttctgagagtacttcagaacaaagcagttctgaagtagttaaatcaaccttttattcatcatcatcatcatcatcatcatcatcattttcaccatcttcttcttctacttatatttcttcagagagtcattcggaacaaaataattccaaagtagtcaaaccaacgtctaattccccagaaagttattcgcaatctgcaacgtcagatgaagcggcttcctccactgaggtaactactaccaccggtacctttgagacccgcacagaaatgaatactgctgaaaagccctcaaccatttccaaatcgaccgctacattcaatggaactacatcttttgaagcgatctatagtggtgctgctttgaggaatggccttgacttcagtgctgttttgttggttgcatatgccttagtttaagtggagaggattcactactcaattatcttttatcaaacctccacgttattgtggacataggtttcattgtcattttggttcaatcctcgacgaaaaaaaccggcaaaaaacaactgttatgttctttcgtcttctagatagcatcgtgactacaaataggtgctgtgaatgcgatctatttttacgttttttttatacctatcaacatgatctttctgacacactttttcactgaataaacaattttatgctattctcagctttcaccttctgcttatcttgcaaaagtaaaaacattgttttctatatcttataatcatttcctatagttctataagctggccctcccttgtattaagtatcaaattgcaaaatactcctatgtctttcttctataaatcgatgtaaggggagagatgtaactttaatttatgaggatttttggaaaacgcagaaaatccgttaaaaaaacaactttaaacacctgaatgtcacaatttgttttttggtactatgaatacaatagccaacaaactcgtaaggctgaccacaagattcgcatattgtcaaaaaaacgaagtcttcaaagaaaggattgacaaaagcccgcatttaaccttaggttaatgagttcttatgaatcttaatatttgccatttcatgaaactgttttctattttttccccacctgaatttatcttgcagctttttcaatccaatacttctatgcatattctatcacacattttggaagctgtgagaagcatgttaggaaaaatgcttgtgcattctttatacttcaggttgaacatagaaaaactacaaaattatcataggagctgcaataagctttacacagaatcacacgtcccgattacctgggtatttatttgtattgctatggaactcatagaaagttttttcagaaattctacatgtggattattaagattaagagggaccctattataatcaattgtctgtgacataggcctcgattttactaaggggcaccacgtgtgatagaaataagatatatttgtgcaggaaacccatgctgatgagctctgaattgtttcaccaactgcaaacggaatttttttttttttttttttttttttgacagcattaaaggtcatgaattaaatagatctaccatctgatcttccctttttgtcgtggtattataaccttttgaaagatatggtactcaaacacaatccggtacacataggaaggaaatgatccaagataaatcgttagaactaaacatttttacgacgtgctttattatgacatcaattataataacaacgtgctcgtaatcaatacctttttttgttagaacttgactgccgtagtggagtgtctctgaagattataaatacccagaaccaggcattggtggtaatcttaaacaatttccagtatgtaaggcatttggcaccaattccgtaataatagatcaaccggtgatcataaaacatagttgtcgtccgcttagattctaagttttcaagtgaaagcatggtaggatttctagcgtttttgtctgtcattttgtcaattgttcatgcgatacctgttataactgcagatgtagtagcaaaaaatctttttaccaggaaagaaatgtcacaagaagcgatatttcccatgttgaacggtgaggcgccctattttccgtatcctgagaccaacggaatttcactcgaaattcctgagcagtgcattattgaacaggtacagatgatagctcggcatgccgaacgttttccaaaagctgcaaagggagaaaagctagaaattatgtggaacaaatttaaagagatgaagggtgaattcaagggtccgttggcaatattcaacgagtatgaatatctcgtcgaggacaatatctatcttgatcagatgactaattcttcaaatgtcgatggctccaatccatacatgggctccaaaaccgcacaacaattggggaactatattgctgtccattacggtgagctaattggtgattcattgcctattttctcttccagcgctgggagggtttatgaaacggctaaaaatgtaatcattggtctgcaggaagaacttggcttcaacgttgacgtccaattacaaataatatcggaagatcaggcttctggagcaaattccttaactcctcgtaattcatgtaaaaattataattccgagtttgccaaacaagttttaggaagtgtcaatgactcgcagttaaagaagatcagggaaagactgatgaagaagaactctcagttgcccttgaaactaaaaaacaaagatataaaacaactaatttcgtggtgcgcatatgaaataaatattaaaggctactctcccgtgtgcgatctttttggagatgaggatttagtctcatactcttatttctccgacatggaaaacttttataacagtggtcttggaaatcctctagcaaagtcattgggatctgtattacttaacgcttcgtatcaacttttaaaggagagtgaacacttggagaataaagtctggttgtcatttactcacgatactgatattcaacactttgtgtcagctattggattatttgatgatggagcagagcgtttccaaggcgaacaagtctcgttccaaaatatctttaaaagaggtagttggatcactcctatgggtgctagactcttcactgagaagttgcgttgcagaaacagctcttttgttcggtatatacttaatgatgcggtcattcctatcccaggatgtagttcagggccaggactatcatgtcccttctccgaactcagcagctatattaaaaaccaaactagcaaaacaaactatgtttctcactgtgaaattactgaagtctcgaataagacggagttgacgtttttctgggattataatgatgtggattattcacgtactcccatcaattacaaagttagtgctattttggataagactgaatagcgaaccacaaaatgatcgtcaattggcctcttctgccctaggaagtaccgttggtattgttccaggtcaatttactcagcttagtagaaattcttgtgttagtattgttttcaataaaaaactatcaaaaatcgtacgtgccacatctataagcagcattgatacgaccagatatcatttttgtttccttctccgtgcctctatcaagccttaggtttcccacttttcagtttctgcaggctggattttatgagcaatagtcgcatctatggaggcaatgttatgtattctcatagtgccacaattctagtaattttggcgacctaaaaatatctttgttggacttgataatcatcaaatttggcagtagggactttgcttagagggttagtagtattcatgcagatggataccattttgagttgtagttgttaatgaaataaatggatggttcaattggtaatcggtatgcgaacttcgactagttaagtaaattacttacggtgttctccttggtttcttacatctgacatataagccaatgtagaacaataactaatatgtcgaatccaaatgggaaaactggatgaagaaacactctggctgtatactttttggattggtcttcgattcatcaaacgctgtagcctcgatcatagttgcactcaacttcaacttcttatctagcattggttcaataactggcgccttagaaatgctcctacaacgccagagaacaacagcatattttgtcctttctttattcgtttaccaataatttttcactttcggtgtgtctaagtgcattcatttcattagcatggatactatctaaaaaagacctgaaaaataaagcagaatatgatatcgatttggtttttttggaattaatgcataattctggtgtgtatttcctgcagaacatgaaaagagaatctttttgattttccggcactgtatcacggctgctgtaacgggtgcatttttaatattgagacttagaaaacatgtctaaaagttataaaggttctcaaaatatgtgtaaagctgtaagcatcattcaattcttttggcgtagataccatcaaggagttgttgtttcacataaatattataatattcatggtagtattttggcacacttctgtgatctctcgttattggtttggtttacttttaagaggcaagagtagcatataccgaaccaagtaattccctaggacccaggataatgctttgatgtattcatcatagttttaattatttcatttgagtaagtttatttataaattggtatacgtatatatactgcatttaaatatcccgcaggcagcaaatattatgaaccctcatatgttttgtttagtcctggtgtttggataagatagcgtcaagaacgtcttgaccgaccttctcctcatattcttcgtctgtcaagtttgattttggaccactatagaacttgtacttgtaaacgagatagtaaatcgtaggcaagacccatactgcgccaatgaaaactacactgtagttcatcgtgtctggggtgatgccgtgctgatccgctgggaagaaaactaataatatcatgaaaatttcaaatacgatagaaatccaatttaccactggagaaagatacttccccatgaaaaaagcacccggggtgaatacatctttcccataagtcattctcaacaagtttggaaccatccaggaaaagtagttcgcagaaacagccaaggagaataatgctgaagatgctactgggccaatcaagcacaaacaaccaatggccaaagcggcaccagcgccgacccaggttgctctcaatggagacgatagcttgatattgacgactttgatccaggaagagaacggtaatccatcatcacgggcaaaagcccaaatttgtctggagatagcagttaagatagaagctgccatcaaaaattggcagaaggcaataaggaccatgatagcaatggtccatcttttgcctaaggcgtcaaatagaatttgagccaaaggttggtgaaatttagtttctacaatagcagcgacgtcttgtgaggagcaggcagcaataacaatacatataaagaagcccaaaacccaacatacactgatggatccaatgataccgaatggaactgaagctgtggcatttttggcttcctcggacatatgaatacaggagtcaaaaccaccaataacccaaataagcggttggaagccagctgacatgaattgccatccatcattccagtccgacaagttttggaagttaccaaatatatatttagcgtcattgaattccatgtggttcgatctggcgacaccaactggaagggcaacgaagaaaatgcaaatcaacagtaaattggacacaatggagaatgtttgcaactttgagactgcaacagtggcaacggaagtgacaaccgcagtagctacaatacatgccgcgtagacaccatatgtgcttgcgtttgtgatgttaaaattaccgtcgctgccaacaacaacgatggatagtatttctcctgctaaaccataattgatggaacaaagaccagcaattaatgctagcgaattagagttaccaacaacaaaagaaagtagatttttaacctttggaggagcgtaataataggtgtaataataaagaccaccggaagttggaatggcagatgctaactctgacatggcaagaccattggttaagacgaatgcacctgcgataccccaaccccaaacaagagatacagagccaccaggcaaggcaagacttaatacagatgcaatggatggcaatagacccataatagagaatgcaacaccgaacacttgaatcttcgaaaaatgcctttgcaactcttgcttatacccaatttcagccaacaattctgtgtcatcatgtgccgccttagcattaatgtaattaacatcaccgacccttcttgacgttatggttcttaatgatgtaaccacatcaaccttatttttcacctcttgggctccgataatataattgttcttttcagaccccgaagagacagaagcggacataactaatctttaatattccgcgtgataactgttgattactagttacctgaacttcttgactccatagaaaaggcaactcggaagtgaaacagaggcattttattagtaaaaccgttgcaggtatcaggataaagatttattccaactatcattatttatactatgcatctctgaagaggatgagttatattcgttcttatctaaacattttgagtctcatcttatctttatctaagaagttcaaagttagccgttccaggagatgaagagctgaatctacttatcagatattaaagcacaagttagtgtctcaactcaggttaaacgaagtaggaataatttaaacgttctgtaaaacttagttatctcatgctatttccaaaagttcatatcatcctctctccgatagtagaacctaaagctcatactactaacagtaaaaaaagtgataattctatgggctgcattcactgtctaacttacttcgcgacaaatataacaatagcttctgcagggtgttctccgattatcttcaagtatctagacaagttaatcttaaggggggttttaccaaataaaatttctctgtctgtgtaagatccttccgtttatttcgaccttaccatcgcttagcatttattatatattggaaatcttatactgcttatctgatagtaaatgctcgactactttcgcaatgaagataacgtagtataaccagttacagtattatcagcattcccgctcgctcttcgtaaagaggggaactggttttcaatggttcccattatccctggagaaattcaataatggtttctctcgaataaggactggcatagtaaaacagaagctatgataattggtcatattctatacagaaacacgtcttatctttgaacaaaaatgacgttcaaacaaagcattggttaggttgattttcactggctacggaacagtgtgtgcgcttaaaggtatccgacagctcatgttccagcaactatatgttacaaaacggtcacatgatcgatatggaggtcattttcaagaaaaggaactttttttaagataacaatagttcttatcagtgaaaggcagtttctctgatacggacatggcgcggtgtgaccataaatggaaattccttgcgctacattgacagttaatctgtaaactttccgcttagaagttcaagttgggggctttattgaatgttacattagttacaaccttatcctgttcctcagaagttgcaacttgacatccatcgctggatccggatgaagcattcacgtgatcggtaactgattcaaggaccaagtagaaagatggttgtgattatacagtatccttcaatttaagtttactacgaggtagtggtaccgaatgctcacccgtgcacaataatcacgtgcagcgttgaagcatccttctttctgcgagtcctttatcgaatgtcaatcatcctcgtttatgtgatgggatttcgcaattagatgactaaatataaccactgaaaccatctcacgttaatgaagggaggaagggaaacagaatctgcaaaaatcacatagaaatgtgccttctctcaaaacccgtataattgatgcctccttctgaaaccagcttttctgcagggaattcttcggccctcatgcaatgaaaaaaaaaaaactttattctgaacgcacttgcttagtctatattttgtgcatatgcacatgtagtggctgccagatgaacgagagaagtaagacaagggagaaatttatccaatatattaaataggctacttgaaagaataataatttagtcgagagaatccgtgattcaatgggtccgtcagttactcacatcgtcataccttgaaaaataatatgcagtaataggctgtgaagtattggacgttatggctaagaaaaaaaactttcatttaagattactctgtaagtcggtgttagttttctttcagcaaattccagagtctgatatttatattgaatctatacacttcttgagttttcattgattacaattcttgatatacaggcgatgttaggtagcttatcattgataggcacacagttccacgttccttattaagacaactgaccataacgtaacgctttacgaatttctttaatcagtggaaggttaagttgcgacagctttcgcatcacacaatattacaagtgactcgtcagattagatcacgtggaattaaatctcaggttcaaataggtatcgattgagagcacaaaagataattaggcatctttaaaaacgcaaataggatgttaagaacgcaattgtggggtattaaaaaactagagatagttgctcaacatgcggtaacaaggattcagcaaacaaaatattagttctctattaagagttactatatattgtattcgtcttctgtgtcaaatgattatatgaggatgcatgcaggatctacggcattgaacgtaaaacctcagctatcaggatgaagtgactgttctttctacatgctcaacagacaatcgcttaccatcttctagcataatttgggatgtcatttctggaagttgaatgatacgatctccaaatacctcatcaacttcttccaaagatcttcctgaagtttcaacgaaagtgaaataacaaacaacaatctcaacagataagaagcagcaataaaagatgtagtatttccattcaatagcatccattgcaattggattgacaaacccattgaatataactgaaatactaatggctaactggaaaattgtaagccctttacctctcaaagtgtaaggtaatatttcagttgtgtaaagatttgggaaaccgttgaacccgaagttgtaagaaagataatataagaagatcattgccaagactccatttgctagagtcttatcctcaaaattacgcttttggttttctgcagacaatgctgtccacacaacgtaacaagaagtcattgaaactaaggatatcaagaataattgtcttcttttgaagaatggggcgatgtaacctattaaaattagtgaacataaccagttgtaaagcattaaccaaccattccatttcaattgatcatcaggatcagttataccaatggagttgaagacttttgataaatagtaagacactaatccatttccggaaagttgtgtgaaaattgcagtccagatcaaaatccacaatctatgacgattaccggaagttttaatgaaatcagagaacttggtagattgggaagctttttcttgttcaatagccaatttaatttctgccagctcaaaatcgatcaaacctgcgtattcctcattatttcctgcgtgatatttattcaagattgctcttgcttcagcatctctattatggaacaccaaatatcttggagattctgggcatttgtatagcgcgacgagctgaacgagtggaaacaaagcttgaatgatagatggaattctccagttccagtggtgagctagatttctgcagccataggtgacccaagctgaaacaatagcgccaaggtaccaacacgtattatatatggaagtacaaagctctctgtgaggcggatatgatatttctgagatcaaagctggtgtggcaatactgatcaacaatactccagaacctaagataatacgtgaagcaacaaacataccgaagacgtcttttctgtcatagtcctcaggtaaaccattgatccatgtaccagacaatgcttggatgaggacaccaatgcaaatcaagacattaccgacatacatcccgacctttcgaccatacttgtcaatgatgaatggtgcaagttggaatagtataagcataccaaacaccataccattagagataacacccaactctgcaccattgggattacccatcgcattgaggtaatccggcatagcatacaatccgttcaagagagaaccatcgtaaccaaggtttgtagaggagagggataagccaacgatgaaccatgacagtgttcttagatagggcaccttgtagaatggcttacccaagtcaggcaagacatcagacatcaccatgtgatacctttcatctgcactgactttgtctgctgaacaagaatcagtgattttattctttgctttgtcagaaactgaatcagtcgacatttctaatattttgctatcaggtagacgtcactattgtaataatttgagtaatgttttcaatgcttttaattggtattacaatgaaatttataaactagggctgtatggagaactgaaactaaacttttcggtgaaataagaaagtatatgcgctcactttaaccttttatattaaacttttcggaaatgttaacatcaaataccaaagaagacttaaaactgggggatgttcgtgtgagagatagggtagtcactgcgtttgaaagtatcaacatttgctgaaactgcaataagaatccactatgcaatttcttttgatccatttgcttggtaaaagaaagacaccaattattatcactatgatcatgactactaccatgactataaccctggatgagcttgcactcgaaaatcctgctgagcatgttaaaaacattaaactaacaatgagatccaacttttaacgcgaaattgtacactctcagtaattactggtcacaaccaaaggtatgtactatgttccttttctccagatctgccatcctcctctattcattattcacacttaaacaatatctctcgataaagaaagccatgtagtcaaattacgaaagaaccatttcctatttctcttagatcacggtaaactttctttggacagggggtgtcatagcatcacttacaggtatcgtaaagattacttgcaaccaaattcttgccgaattttctccagatagtgaagtggcttcagccacttcaaggtaccttgataggcacccaagttggagttgttgctcgaagccagtgttcaactttttcgcaggaattacttccacagaaaactatgtactactaagctgaaagcttgcataacggttgatatttctattttccgttgctaattattgcggggaaaactgcaactgacattagtgagtacttttagtttttcctgtttaagtttttttcgaacaaaagaatataaggtttgttttctgcagccattgttttccctgcttctattgcagtgacgtagaagaaaacgcagtggagcgggtgattaccccaggtaatttaaacataacacagaaaagtgaatcagttatatatgcagtaatgttttgtgcttctatggaaacaaccgagcgagaaaacacaagaatgttgaacataatgggtgaatgagttggctttgtccctgttcttaaggtcatactggggtaacattgaactgaactggaaaacactttgaataaattagtgttacaccagtgaacggatatattgtttggattcggagatatcttccccaaatttagtttaaagtttcccaacaggcgcggacggacaatataatttacaagcattatttgccaatgattttattttgtggggaaagatgggcatctctgttgcgactgtgtgatcaatatactccactacatgaactgtgcgagggatgagtatgtatttggttggtttacaaaacgactctgcccgtcagttgtctcggcctgagctaccagaacttgagattggtacactgaacgtagagatgggaactgaacttacatgacgatgaaagaatgacttaattttagtcatataatctgtttacctgttactatgcggttttgcttttcgttgcaatgactaaaaattcgtccttgatattgaaactatcggataaaaattatcctagatagtagcttttttcttattttcatgcatgttcgttgtttcctggagaaatcgtaaaacacctgtttggttgcacatcactgatggtggctttagtaatactacaagatataatggtagattaatggcttttgcatgaaaactatttaagaaaacctttttttacatttaggatttcgattgacccagtttgcattcccaatattgataaaggccactgttgttcacttgaacaacaatactcataagcacttaactacggacttgtatttaatttcttgaatcatgtctaaatttgatatcgaacaaacgttaggcaaactaaccagagatgaaaaaatctctttgctatcagccgttgacttttggcacacaaaggagattgaacgtctggggattccgtcagtgagggtttctgatggtcccaatggtatcagaggtactaggtttttcgactcagttccttcaggctgttttcctaacggaaccggtctagcttccacatttgatgaggaactgttgaaagaggcaggtaaattgatgggtaaggaagccgtcgccaagaatgctgctgtgattttgggacccacggctaacatgcaacgtggtcctttgggtggtcgtggctttgaatcattttctgaagatccatatttagctggtgttgctactgcttcggttgttcaaggaatccaatctgagggtattgctgctacggtaaagcactttgtctgtaatgatctagaagatcaacgtttctcttcgaatgccacgctctctgagagagcgttgcgagaaatatacttagaacctttcagattggcagtcaagaatgctgatcctgtttgtttaatgtccgcttacaataaggtgaacggcgaacattgttctcagaacaaaaaattgttattggacattcttagaaaagaatggaattgggatggtatgattatgtctgattggtttggtacttacaccactgctgcttctatcaagaatggtctggatattgagttcccaggtccaacgagatggagaactaatgaacttgtttcacattctctaaattccagggaacaaatttctatttatgacgttgacgaccgtgttagacaagttttgaaaatgattaagtttgttcttgacaaccaggaaaagacggggattgttcaaaatggtccagaaaccacatctaacaatagtaaagagacctctgaattgcttagaaagatagctgcggattccattgtcttgttgaagaacgagaattcgattctacctttgaaaaaagaagaatcagtcgtcgttattggtccaaacgccaaagcaaaggcttcttctggaggtggttctgcatctatgaactcttactatgttatttcaccttacgaagggatcgtcaagaaagtgggcaaggaagtaccatatacaattggggcagagtctcataagaccttatctaatttaattgagcaactggtagttgatccttcaaaaccagcagaaggagataatgcaggtgctaccggtttcttttacagtgagccagttgaaaagagagcaaaggatgaatctccatttcatgttgctgcttttaagcattctttcaacttacttttcgatttcaaacatgataaaattgacacgaataacccattattttacatcacacttgaaggttacttcactcctgaggaagatgctaactacatatttggtttgcaggtttacggtactggtctattgtacttggatgaagaattattgattgatcagaagaaaggtcaaacccgtggtggattctgtttcggtgctggtaccaatgaaaagactaagactgttactctacaaaagggtaaatcgtataaagtcagaatcgaatatggctctggcccaactagccaactggtaagtgaattcggagctggtgctctccaggttggtgttgcaaaggctattgatgcagatgaggaaatcaagaaggcagcaaaacttgctgcgggtcacgataaagccattttatgtattggtttgaacgcagaatgggaatctgaaggtcatgatagggaagatatgactttgccaggaagaacaaacgatctcgtccgtgctgttttggaggccaatcctaacactgtaattgtcaaccagtctggtactcctgtcgagttcccatgattacaaaaagctaaagctctcattcaagcttggtacggaggtaatgagttgggcaatgctattgctgatgtcttgtatggtgacgttattccaagtggtaaattatctctctcatggccaataaaccttgaagataacccaacttatttgaacttcaagactgaatttggcagagttctctacggtgaggatattttcattggatacagattctatgagaagttgcaaagaagagttgcattccccttcggttacgggttatcttatactgaatttgctttatctaatctacaagtacaaacggatgaggaggttatctctgtttctgttaatgtaaagaacgcaggtgaggcatatgcgggatccgaagtcgtacaaatttacattgctgcgactgaatcatctttttctagggcagtcaaagagttgaagggattcaagaaaattttgcttcaacctgggcaaaacgaaacagtcaaagttgatttaatcttgaaggattctatttccttcttcgatgaagaagtcggtaagtggtgttcagaagctggtcagtacaaagtcttggtaggcacatcttcagatgacattgtgctgagtgaatctttcgacgtgaagaaaacctcgtattggacaggtttgtagttggccaatacgcttcacttgcaacatgttttactgtccacatttataaagtatctagatgtcttttatgtcgtatgatttttagtaaagaaatagaataatttccagctttgaattctgatgatcgcaataaaaccttggacgattggctataataactgcaatatgattagttggctattcctctcctactacttatacgttgatgacgctgtagatgagaatactggtattcaataaaaccaatacgaaattgaaccaacctcactttttcatgaagttgaatcaatatttagagttgacgtatatatcagtctatacaacatcttctctagatatctgcatcatgtttgagacacatgaacggacccactttttgattatctagatgtgtccgtctgcattaaccacgatactgacacttggagctagaatgaagaacgtgataatatctgcagtaactaaattgacgatattcagcatgcaggtatcatacaatagtttatattataaattacgtaaaaaatagctaaatagctaaatatcatgcttatcgctgcagcgttcaactagtgcttaataaagacatactaaagaaagaataccctcattttttcagtcctgtctcagatatgtattgttggacttgacaattatcagatttcgtagtagggactcagcttagatggttagtagtattcataccaaaggatgccattttgagttgtagtggataatgaaactattggatggttcaattggtaatcggtatgcgaacttcgactagttaagtaaattacttacggtattccccttggtttcttctatctgacatataagttaacgtagaataataattaatatgtcgtcggatccaaatgggaagattgaacgaagaaaaattctgcctgtatactttttggattgggcttctaatcactaaatgttggactggatattcatcaagtttggtagtaggggcttggcctagagggttagtagtattaacgtaattgaatgccatgctgacttgtagttgttaatgaaataaatggataattaaattggtgatcgactagttaagtaaacgacttacggtgttctccttggtttcttccatctgacatataagttagtgtagaacagtaattaatatgtcgtcaaatccagatgggaaattggatgaagaaaccatctacttatatacttttcagattgggcttccaatcaccaaacgctgcagccttgatcctagttcgtctcagcctcagcttcttatttagcattggttcaataactggcgccttagaagtgctcctacaacgccagggaacaacaaacggatagtaaataggcaattgatgtcaaatacagataatatgagagtatggggaaacccatctgttcagggtaacactggccgtagattcggggtctcggcacatcacggtgtgcttgtcggaatagattggggaagagaaaaaaatcaaagtgtacgtttaagatccaaaaattgtggtgagatatctgctttttagtatgggggtggtcaatatggaagaataaacgtctgacccgtacatatctgtgtgtggatcatacgggaacggtatcgtatgtgaataattagggtcctactcccttttatgccgagatttaaaaatagacagcggtaaagatccccattagtcctccaagagacaaattaataggacccttacttggatctcatgattttctacatggtttacatatataaagatattatgagaggaagtttatgtcggcgaatcagtaggattttaatttggtttagtagcagattatttcaattggattgttgaaataaagtatttagaaccaacagttcttacaacaattgaagatgctcgctaaaactttggctttgttattctttgccgtgcaaacttgcgttagggcccaaagtctcgaagttccgcaagtcgaacctattaccactgaaaccactgtattctcgagaggaccgggacagatcactacaacttattccacggaagttgtgactgacgatggcaccattccaaccgttatgactatctactatgtccagatcccttattttgatgatgacgattatgttactgaggagaccatcgtgaccactgaatacacagtgtggacaggcacttatactactacatattccactgaggttttgactctaagcggtggccctataccgactgttaaaaccatttacaaggtgcagaccccagacacgtcagatgatggcggggatgatggcactgaaaccacgaccaccactgaaaccacagagtatactgtatggactggaacgtacaccaccacttattctaccgatgtgctatctgaaaccggtgatgatggtatcgctaccgtcaagacgatttacaaggtgcagactccagacggcacagatgatgatggtggtgccgatgatgaaactaccgctaccactgaaactacacaatacactggctggactggtgcttacgctactacttattccactgacgtcttgactgaaaccggcgaagacggttatccgactatcaagactatctacttagtccaaacacctttatctttctcgaatacaacagatggcgatgatgataagacttcagatgataatggtgatgataacactactgatgacgaaggcagaaccacccttgagccaccaaccacctctacagacactacgactgatcaagatgacaataataatggaggacaaacttcaactccgtcaggtttaacatcggactcgacctcatcaagagtttctactgatggtccaggcaccacatttgaaggtggtgctacaagggtactagctacttctgtctttgttgtattgttggctctattatgatttagttttggtgtttgaagaaaattgtctttcatttgattttgaattacgtttttctcctattttaaaaaggtatcacaactaccgtctacttctaattttttttactgcgatgattttaatataactgtaacctttactgttgatgtagggtactttgtaacacaaagcgaagtattattagattttattatcgaccctcgggtcatcctaattcatagtgcttgaaattatgatgataatttaaaggtataatgaggtgaagtatttctctgaagtcgtagcatcactagtcccgaatacttttctgtttatttttgtatttttacgatgggatttacgatttgaaatgccaatatgaaaattatacaagatgtcagtatattgtctacggttgggatatattcaattgagttcgaactcgttatcctagtatctacagtttttttcatgtattgtgtctctagattgcttgttattatcaacattactggttgactgtccgtcttgcattttattgggattttatgtttagcagtttgacccttgatgacttggctgcaattatctcgtcattacagaggtaaaacaccccctacttcttacttgatctctttgttacctgcgaaaggtgagtcccagataagagtgatttctgcattaaaagtttcagatattctccatcttgtattctaattctgtgccgaaaatgccataatcattaacaccatcttcctctctgtgtataccgtttaccaccttgctgtcggaccggttagagagtttgaagatgagtcaataacatgttcaccgtctttggctacttctaacatatcatctacagataggcatacgacgagtctcaatggatccttggctgtgcacatgcacggcccgaatctgtcttcgaacagcttacattcttcggtggggaactgtttgatcagagcgtaccaaattttccactttgttttagaccattcaaggacttatttattttcagcaccttatttctgatgttcatgtgaggtggtgctttgatagatagtccttttttgagatctgcaattagagatattcggatgaaatgtcgggttgaagggcagtcagattatggtcgaatgacatggcgagagcggacatcagagcagagtggtgcacgtattagcctttttgtttagtgtgataggtctcgagtgattgttgatcgcctcgcgcaactcatctacattttttggaattatcttttttactgctaaaaatgaatgtcgagtctagagttttctgttatggaatagagtagatgactggacctgcatcttatgggaccgaactaatccatgtgaagatactcaaatggacggcattcttttgtgcagcctattcaggaattgacatagttaatgtttctcttgggtttattttcgaagcattgttgatattggaatgagctacaatgggtcgaatcgatgtcgtcgtcctttaatcactgaatatggcctttcctaatggattttaactgacatttatatggccgaaccagcgatgagcatttaccaaagagaacttacttggagtctctctgattcagatagctgaattactcttattcgatttttcttgggcatccacaagttgttcatcacttttacgattcaaattgtgaagtaaactcttgtcaagaacaacagatatagttgaccctggttattttagttatacgagtcccttgggtgaagcctaaggtccgcagaagcaagttttgacggaacgttttgtattgtttctttgttattttcgttcccttgaagtatattgattgctgttgttaaaacggttaattttttgcttcctttcattagaactgttattccattgtttaccttgatgtttgttgtacttacgttctggttctttagcatcttttttgtcccaatacgctgataataagattctcatgaggttcatgaagctttggtccttttcacggtgaaacgttactatcactaatagatattcattatgcaaaacttccaggacctgagatgttaataactcatctaaatcggaaactttagctctttctgctctttgatagagtttggttgctctctgtgcaaatttctcgatcgattctctgtcgcgtagagataatgctacaatttcgcgcagtaaggttagtttatcattttcttctgagatgattgccacagcttctaagaaacaatctatgaactccatgttattctccagacactttttgaaccatttgggatagctggtgttgggaacacatgccgtatggatgttggcaatgtattcttcttcatcatcttttaaacattttctatacccatttctccgtgctgataagttctcgcctagaccctgtttgcgcaatatttcactaaattcccatacccaatccttataatcatgagagtagaacactctcgacagtgtgaaagttgagttggggtcatgcaagcagctgaatgtgtaccctaacggaacttggatttggtatcccaaaccaggtgacatctggaaaggtggaaaaggatttggatgaccttggttcgtcccttcatacatggctgggaacttgccttggctcccggtgtttcctggaaactgagcaggttggtcatgtgatgatggaagggctgttcgttgagccgcgttaatgaatggtgcaaaatttgcatcttgatagtaattcatatatggaaattgttcaaaaaactgtggtgggtacggacaataataatagccgtttggaatgggtggaacattggcaggagagttgatctgagtattctgattgccggttgtggcaatagagtcgttagcgccgctaccatgtttgactggattatgatcagatttggtagttctcatgtcaatagatgccatgttggctcgaggctgataatgctattggacaattgaattggtggtcggtatattagcttcaactaactgagtgatatgaaccaagatgtatcacatacttatatatattgtagaaaactattggtgaaaccttctgtcacgcaatcatatctcgaattcttcaatttttcagccttttgatgatgtttctgccttgtatttctcaaatagggaggatgaacgagattttttaacttgtatgacttttatgttttcgaaattaaaaccaagatttgagatggaaaaatgaaaaggatggaaataagttcggacaagcatagcgatactcagcacagaacggtgtatactaaatagtcgatcgatgtcagatacagatagtatgagcaaaggaacaccatccagtcagagcaattgaccagagatatgtcacgtgatactacttgaattaagctctaatgcctacagatctccgtatgatactctagaaagcttcaatttgtggtcttgatgttgctgaacagaaagtgtataagaaatggagttgcttcacgtatagtgaatcaatcgaagctcaagaagacgaggaggtttactactacaaaatgtagcatttactaactacataacaaaataaaaaagtaagaatgataaattctttgaatcaccctattgccactattgttcttgaaccacttagttactgcaccctgtgctgttcctttttctacggtagtgtctcaattcgtcctagtagccgaatattggaagtaaaccctatgcgtggccgtaatttgcaacacacctgtgtcagcgcatactcttgctttagatctcaaaactacgatgctggctataccaatcgccgccgacgaaaccagtgaagctctggccaggcaattgaccacttgtgtggatctaccgacctgtacctcggtccaggcaaattggtcttgcgagactccttgctcgtaattaaaagaggtactgctgcacatccctaagttagccaagaaaatgatgccataattaacacttcaatcaacgtcggcctccataaaatttatctcggcatctatacgctgcacatacgcacacaattgaatcaatagaaaacagaatgtgatgaatcaatgcattataggggtcaaggattattaatacaggagtaagtattaaatgaaacgaaaatattaataccgtcaaagggagcataggttttctcaggcctagcaatctgttaaaatatactgtagtgtaaactccatctctttcttgagctttagcagattcagcatagataaaatcagcgatctctaactatactttcgtttacttgaaaattgaaaatgaaaaataaaaaaagagatttgaaggtgcatgtgattacccggacataaaattacgattgaacaacggattggaaagtagtggatggaagataactgtgggtaagaaaatcaagggaggaacaaatgaggggaggcgaattttcagttcacgtgattgaaggtcaatgttacccggaagtggaggacaaacccgaagggaagttgtaaaaatgcaagagaaaggcagataggggagaagagagtaagagtggagtaagaggcacgtgatatgcgataaagcgggttaactgcatgaggtgaggaaggaagtaattttaaatgaggtttggtggcaagagaagcagaaatgggagatgtgggatgggaattgtttgtgcgggtaactgtagtagctcagacaggatcattgagggaacatgatggatggagaggtgtagtttaagtgcgggtaagcagtaattgtgaaaaagatacaatctgatactcagagggagagggagagagactggagggaaaggcggaatgagaagcaggagatgggaagcacgtgatttataagagagcagggtaactaaggaagtgatgaagtgaagtaatttgagatgaagtttgatggcaagaagagcaaaagttggaagaagttgaaaatgggtgatattgtgcgggtaacgtgtgtatcccaggtacaagacaaccatgggcaaggaccaagccaagcattggccatggcaagaagatggattgacaaagaagttgtgatggaagtgcgggtaaggggaaatggtgaaaaacagtcaagaatacagccaaaaaaagtataaattgaggaatgagaatggatgagaggaaaggaggaaaaagaaattaaagtaaaaaacaaagaagcaaaattaccgaaagaggaaatccgtttcgagtgattaaaacatgagaaaatgagataatgagaaaatgagaaaatgagaaatgaggaaatgagaaatttgagaaaatgagaaaatgaaaaaataaaaaaataaaaaagtaaaaaaaaataaaaaaatgaaaaaatgaaattaccagaaaggaagaagggggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggattttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggatttgattaggtatgtggtgtacggacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccacatacctaatcaaatccgtacaccccgctcctccctttctggtaattttacttttatttttttcatttttttcatttttttcatttttttattttttcattttttcattttctcattttctcttttttaatcactctagacggatttcctcttctggtaattttctttttctcattttctcattttctcattttctcttttctaatcactcgaaacggatttcctctttcggtaattttgcttctttgttttttactttaatttctttttcctcttctcctctttcgctttctcctttcactctcatccattctcattcctcaatttatactttttttggcagtattcttgactgtttttcaccatttccccttacccgcacttccatcacattttctttgtcaatccaccttcttgccatggccaatgcttggtcctgctgggcctggtccttgcataggatacacacgttacccgcacaattatcacccattttcaacttcttccaacttttgctcctcttgccatgaaacttcatttcaaattacttcacttcatcacttccttagttaccctgctttattataaatcacgtgcttcccatctcccgcttcccatctcccgcttcccatcacctgcttctcttcacctgcttctcttcactttcatttttcatcccttctcattctacctttctttccctctctccctctgaatatcagaattctccactgtttttcacaattactacttacccgcacttaaactacacttctccatgttaatcaaccttattcctatcctatcctctgatctcatcctggccgtgcctaagctactacagttacccgcacaaacaattcccatcccacatctcccatttctgcttctcttgccaccaaacttcatttaaaattacttcacttcttgaccctaatacttaccctgctttcttctatatcacgtgcctcttatctctcctctcccacccacgcttttccatttcacccaccttctgttctatatcgtttcatacggcacgaacctcagtggttctctcctgtcccatcccatccattctcaatccatacttcaatcctgtttttgtccgggttacccctttccttcaaatctgtttcattttcctttttttcgcttttcatttttcattttcatctctgtcatttcatacggcacggagctaggcacttctcccctgtcccatttcctcacttcttccctctctctccctcagctttcccatttttttcatttttttcatttttcattgcactcactattcctgctaccacaagggtccccccttgtaaatggatgaatcttgctgaacacaagggtcctcccttgtaaatgggtactccattactgaatacacgtgactacttcaaccatcccattttcatttttcattgcactattcctgccaccacaagcatcctcctcaaggggccccccttgtaaatggatggatcattgctgaatacaagggtccccccttgtaattggatgccctttcctgaattcacgtgactgattcaaccattttcattttcatttttcaccacgatcaatcaatcctcgtgaatcatctcctgaacttattcacgtgataaccagaggaagtgtttttcattttcatacttcctgtccatcatccctccatagagaggacctctccctctgtgaatagaatacgcttctccatacacgtgaccaccgcaaacactctactaacaactatctctcgtgaatcatctcctgaactgtgaactatgaactgcctattcaatgtatactgctactctactgtttatatcaattgctcgtctattcctctctctccctctccttcctccctctctctccctcttcttcctccctcttcttcctccctcctccctttcacttttccatctgaaaccttcttttccttttctaaagttgaaaaatctactgaaacgcagtctccagaatcactggaaactgccacagcaccacgtgactagataatgtctttttcacaacgacaacttccggcgaactgaacttacttaaacaatctgtcgttctcgactttaattattctttaatttactcatcaactaaactcaaactgcagagcaataagtccaaaaccaaactactaacatctactaaacatctactagacatgtcatctcaccctttccaggtcattgatttgtgtgctcctgcagaagaaacttcacgtctgctattagaagctgcaaatactcaaggttttctgtttattgacggccactctttttctcaacaacaagtagatgctttgtttcgcttatccatggagtacttcaccaatactccccaccacgaaaagctgcaatatgctttcgatgtcgccaagaattatggatacactgattatactcgtgaacaaggggaccccagcaaggccaaagacttcaaagagtgctacaattttggttctataaatttcagcaatggtacttacaacggccaatcgcggtctacttctgaaaattgtatgcagcatggtgaagttcccccattgtttacttatcacaatgacttaattgttgacagcatcaagaaattccatgagctggccaggaatatcatgggattattcacggtagcccttggaatcatccaagaagatttctttgtatccaggttcagtgacgataagaagaacggatgtgtcatgaggttgttgcactatccccttttcagggatgatggcgttgatggcagctctgggattgacccgacgctaagaattggacctcattcggattacggcgcattgacactcttgcttcaaaaggaaggagagcaagggctggaagtgcaattggacccgggctgtgaccagtggacaaaggttccgtttttgacttccagatacgaaggttcggctcctccaattgtcgttaacttcggtgacatgttgagcttttggacaaaaggcgttattaggagcacgaaacacagagtgaaaattgaccctggtgaaacgagatccagtgacagatactccattgtgttttttacccatcctgacgcagacactaccctagatcccgttccaagtagagtcatcgagagtaactctaatggcattggggcacctccggtgacggcttacgagtatttgtctgctcacctctcccgcgtgatcaactcaattcccagtcatgacggcatggtataggctgcgtcacattctatgacttctttcattttgttttacagttttttttacaggttttttttttgagattattaattttcaattttctactgtaggcagacagagtgaagaatttctaacttgattaactgctattgagcaggtcagccactaacttcaaaccctgacatgtaccctcaaatagttttatatactcccaatacttaccgtacctagtaatgaggctactgaataacgctatactccgaaggagatacgtcggaacattcgctgatgagttataaggtatatcactctctcctattggaacactctgataataaaaagtcatttattttgatgaaaaaagaagagtgaatttgaatctttggatctagaacttgacaacacgactgcataaatgaccagcatgagggccggtggtgaggaaggcctttcacatgtttccctctgcaactggtaattgtgcacctgtaaatcatcaaccggtcgagagagacgaagtctgtcacagagacaacagcacactctcgaactctcgaagttcgaacgtctcagtattgcaatctattggaaaaaaataccagtattgatgtctgcagatattctgctgggtcatctcatcttttatgacaaattttgactctatctcttttgattctactcgtgttggtatgtattttcttcttttttcttaacctggaaacatataaatatacctctaaagaatctgacgttgcacaccaactgacgggatacttcacggtcagtttttatctttacaacctcggacaacttgaatgagtgcaactcttcagagcatcatgtccgagaataatactaccttcagagagaaaggagaggccgctaccagcttggaaacttcaaacatttcttcagcaggagaattgaaagatcctggcagactcgaaaaggagcaaactatttatgaatttgagactgtgccagaagatgaggatgatagctacaacaaaataaaagttccagatggaggctatggctgggtggtggttttctcatccttcttgttaaacttctgcacctctggtgcgtcgtatggttacggtgtttacttgtcatattacatggatagtggaaaatacgaaactggaggtaaactcgactatgctgccattgggggattgagctttggtgttggggttcttttttctcccttgtacaactatatattgataaacacttcaccaaggaagctcatttcgcttggaatcgtcattcagaatgttgccgcgttactagctgccttttctaccaaattatggcaggtgtatctgactcaaggtgtgttcatctcaataggtacaggcgcaatatgctttccaaacactacaatagccgcaccatggtttaggaagaaaagatccctagctctggggattaccgtggccggtacgggggttggaggaatcgttttcaacctctccacccaacgcattattgataattatgattccaagtgggcgttgatttctcaatgtatcatatgctcagtgctgagtactgtagcggtgcttttgattagaaccagaagagacgaggttcagaagtattctgatacgcccacaacagcagtggcgctggatatgttcaagtacccagtgatatggttattgatcctttgggtgtgtttcaccatgcttggttatgttgttcaggtctattctctgttctcgtttacgatttctctcggctacacttccaaacaagcctcggcggtgtcctgtgttatatgtgtgggaatcattgttggaagacctcttgtgggacttgccgccgataagttcggagcggtgacaacagggatgttctgccatctgattgtagctattctgtgttatggaatgtggattccgtgcagaaattacgcaacagttgtcgtgttcggtctcttcgagggaatgttgatgggatcaatatggctactactcacttccataataacacggttggtcggtttgccaaaactagaagcggtgtattcggtagtgtggatgtttcttggagtgtgtgctattgtgtcacctgtaattggtatttctcttgcaaagaacaatgttaagccaggggagaacgcctacttgtacacggcagtttactgtggaacagcgtacctgttggcagcgttagctctttggtgcattcgcggtattattatcgcacgcgacaaagtaagtttggttgaaaagactggctacgatgatggtgagctacatttgagggtaaaccttgtcgatgcgctgaaaggaatggcgcactacggcaagttatatcgaaaggtgtgagaaacttgacagtgttgttccaagacgttgtagagacttttccagttagtcaagtattggaagaatggctgaatctagtgtagtccaggagaaagtatatagcatctagtagttgaacatcaaatccaagcttataaactgaggattctttgtcccctctcccattcgatgttgataacctattcgttattgatctacattaaccaatgtgccaaatagaagaaaccaaagaaaacgtcgaagaagcatcgaatcacatggtaaatattattcactaataactctaacctcgaatttaatacccggagctttccatcattgcctaaacacaaagctgaaatgacaggcatcagattttgttctatcaacgaatcctttcttaagagagtagaaacattgtcggataactgccaaatgctaaggccccataataccaattacaaaacgcaatgcttttgccacaaaccgattgcccattgcagaatacggcatcctcgacatctcttgttactgccccggcaatgatctgttttaccgcagaattgcccacagttgttgatcgctctttgtttcaaaccacttggagtagctactaatgtgtggggctcggctatggtttctgtaaaggaaccatttacactagcttgtacctcctcgctttcaataaaattagctacattaaagtgttagtgactagcgaaaaagtctgaagttgcagcaactgttgcgaacgattcccaacggtaaaatgacccgttttcaaagtacgcactcacattcaaaaagtacccactactgttgtcggcggatgagataacggtgaatgtatcgccagctaaactttgatcgaacaaacggaaattcggaatggaactagcaagcaataaacattcccagctgaccatcgtatttgtgctatcggacttatttggttgcttgaatcagaaactttcagcaataaataattgttgctggaagagtttaagcttcaagttgtattatcttggcatttctatatctacataccttttacatgtgagggaatgcggttttatcttgtagatgtctgtttcacttacgttgctgcatatattcgttccttacattttcaatgcagtgcaaaaaatggctaacaataaaagcagaagatgaagaaaattgaaaaagtcaaagaataacgaagctccggtatgtggctagtcagacctgtgcagaaccatgcagaccagtccagcgtttattttcgtttcctttttcccttttttgcaacttttgacgttgcctgtatctcattccttcatgagctagcaatagcaggtaataacgtagaatgttgaagtgaaggaagaagctgcggggaaagtgtgttcagcttttagacttaattttcatggtactacgtgatctctggaggaaataatcctcaagcttggtttttaggcactgcgaacttgtcgctgagcataattcaacttaatccatgttttctggagcctttaacaataaatcctgattatgcactgcttttcattccgtattaggtataatgatttggggtgttttgggattttcactgatcatagctcttagacttaatattttcgattgccttgaggttcaacaaccagtatttcttggttatgatcccacagcctctgtttgagcaattatcatcgcgtgataacatgtatcggaggaagtagatcttttgagaaaaaggcttggcacctacgctacctgatatacacaaacagtaagcgatgatgacacgtagcagttcctttaatgtggtccctggcacgaatgtgtaccggtgtcaggtatcaaacactaaacactcattcgtatttaccaaagatataaaataggtgttgtttactggatctgtcgtaatatctttagctgtatcttcacttagtattttttgatgatcggtttatatattatcatttagacttcgctcagtatagataatctaataccgccgccatgtacattagcttggtttatttggaagttttattgtccttttcgctactttctccggctgcagccgctccgctgcctgatgcaaactccaccgctgtcaactcacttgaattcgatatggtttccaattccacttcagtttgtttcaattccactaactatgccattgatgtttctgagctccctcttccagaatggttagatgactgggattctttattacttgctatgccgtgcggtgatgaaattttcgtttctgttccaaaagatctggacagcaacactacagcaaagatactggcttattctttagcttctggtattgcagtggataattggaatagtgaactgcagaagagagaaaacattcaggcagatcttgatgccttctgggaaacaggcactgttgagctagactcgctatcaattgtacaaaattgattgcacaagaatgttgtttctttgcggttgtaggggtatttctaaggcgtcatttagtgaaccattgctaaataagaagttgagctgagagcaactaggatcagcatcaaggctacagcaccattatttgaacatcagatgtaacaagtatataagtagaaggttacttcatccaattttcccctctggatttgacgacatattaattattgttctacagtgacttatatgtcagatgtaagaaaccaaggggaacaccgtaagtaatttacttaattagtcgaagttcgtataccgatcaccaatttaactatccgattatttcattaacaactacaagtcagaatggcatccagttacatcaatactactaaccctctaggtcaagcccctactaccaaacttgatgaatatccagtgcaacataaagttcttggttgtgaggtgttatggttccaagtaagactacagactctacttcgtcgatgtatatgtgcggaccatggcagctattgattatgttcttgattatggtaatgattattaatcaaatacttatctcagtgttaaacttttgattttttagcttgatttctaatcaaaatactagtgtaaaatgagagacattgtataaaacaggaacagctcgctcaagcaattacacgtctgtggaagtattgtcgacgattttgttcaaaatattacaacactaaggtcaatgaaagaattctttgtcacaggtgagaacactctgaagggcggtgaagatgcccaaaattcggaagttctggacggccagaaaaaagcacgctccatggtgtatagcaccatcaaatctgtatcttatctagatttacttttgcccttcaccattctactctgtatgatagtttccatattaatatctgtctatgtgccgtcctcccgtcacacattcgatgctgagaaccatgctagtttggtgaacgtctccataccacttgcaatcgggatgattgtcatgatgattcctccaatttgcaaagtgtcttgggagtctatacacaaatacttgaaggaaaagtatgtatggaggcaattattgctatctcttattctcaactggatttttggaccattgttaatgacggccttggcatggttagccttatttgagcacaaagagtatcgtgagggtattataatgataggaatcgccagatgtattgcaatggtattgatttggaaccaaattgctggtggtgataacgatttgtgtgttgttttggttgtttgcaattcggtattgcagatggtcctatatgcgcctttacaattactatactgctacgtgatttcaaatgaccattttcagggttcttacaacgcaatgtttagcgaggtggccaagtccgttagcgcatttcttggaataccattatgttgtgggattctaattcgtttaatatttgtttacagtattgggaaacacaattatgaaaagcatattctcaaatacatatctccatgggctatgataggctttcactatacaatttgcatcctatttgtcagtcgtgggtatcagttcattcatgagattggatccgctttcttgtgtttcatccctttggtcttatacttcatcctcgcctggagcttcacgtttgtcctcatgaggtatctaacgaacacaaagcccagtgacgatgaaaaatgcgaatgcgatcaagagcagcttcttctaaagaaaaattgggggaaaaagacttgcagttcaagctaccccataactatgacacagtgttttacaacagcctccaacaacttcgagttatcgttggccgttgcaatatcgatttatggaaacgatagtcagcaagccatagctgcaacttttggaccattgttggaggttcctatcttaatgatattggccattttcgctagatatctacggatacgattcatatggaggactgatgttccactcaaagctgaaagctagcaaataaaagtatttatcaaatatgagcataccctctagatcaagtccctactaccaaacatgatgaatatccagtgcaacaaggagagtttgaatacatttcggtggtgtaatacaaaaacttgagatgtttgaggaatctgagggagtgagaaaaaactgaaaaagaaatacattaatcaatcaagagagaaacgtaaactgttgaacctaaggcaaaaaaccttagtaacgtagagatcgcacttgaaataatattagacgtacatcgaacatttttcatagttatcctatttttgtcgagtgttgttttgtaaacgtcgtcagataatgattcaaagaccacttgtttgaaagaatattctcagtccaatcaaagctaccatactcaacaagatacaaaacaaaatcctgatcatagtcagacgcacatagcagtggaagatgatcatgaaattttggctcgattcccaaaagtacagccaaattacttcgaacagagctcttttgggctgtcgactgattacagtttatggaagctgtgctatgactattttgccttgagagaatgcaaacttggtacggtctattctcatgaagctgcaggtgttgagtggcagctgatatttacaccaactattttaactgtgatccgtcatactatccgacaatcgatgatatagagtgcgctcttcatgttttattgaattcgagtggttacgacaagaagttagctttctgtataagactctacaatgatgaccggtcattcacagatttacgaattcaaagagctaaaaacccagcatatagacaaattaccgaaatgaattgtaaaagaggatatgaacgaagatttcctgagcaatgtggtgtatttactggtgggatttttttttcactggacagattttttcaaacgaaaaccagacaaaatcctcagaagcgtagaattaaataaaacacaaaaaaacaaaaatcaaactcttagaataatctgcaaggagaaccgaatcaaatagaatactataggctaaatcagctcatcacttatcacttaaggatgtttgtatttgttgttcccagcatgcaccaatggtcccagcgcgacaaccataggaaatcccaataacacatatgggaaacgagtaaaactagtagcacgaaatttgtaacctttattcttttctctaatacttcagagatgatttaaccggtggatttcaaagggtaaaacactcgatattgattaaatgcaccaaaatttgttcagccagtaagcaaatgaagctgctcaggttattaattcaataatttcatcccaagagctgtaaattactcctctaccaactcccatcaaagggaatttttctgatgaatgcatcgggtactgagatgagtcgtatatccatggatttgagagttcagaaaagtatcaaaggcaaggagaagcgtaagttgaaatttgtttggaaagaacagatgtgggaaccaaggctttgagacaatgattaactttgaaaggctgaaaagattttgcctttgtaaagcgcttcttttccaaaaaatgctaacagataagcttactgatcccttttgtgtacatcgaaaactgcgaaagacaatgcccagactaattcctgaaggagcaaatacttttgtaagcgtgcagacggatgatgtgcgtagagcaccccacacacgaacctattgcgttccacacttgattgagcacagtgaaaggatccgcattcagagagctacgtatttgaagaggcttttgcaaattaatacaaggtacctacgattctcatgcttcattaccttgaagtatattcaagatcaataggaacattgttttcttggctaagatctactgatagacacaatgagtcgacaaggcttgtttattttctcttcaagggcgtgcaggaaattgcgcctcgacatttgttggtacccccgttatttcttaacttgtctgttttcttctgctgacattgtttcgaaaagggctaagaatttcttcataaggcttagaactttggcagttttcctgccgcaggaaagcggcaggaataaaaaaaaagaatgttggacgccgttttcattggtcccgtgatcagctgttcaatggcagctttccacatctccacggcattcctcctatagcccctacccctatccatggtcctgtttcttactttgatgctagaactgtgcatggttcagggcttctctaactaatcacatttcatcgcatatctgcctatggggagcatatcgataatcaatccatcttgccattggcattgccttgttgtatcggacctaagatataaatacactcatggaagttcaacattttacgatcaatgttctgctttcggagggtccagaatagctgaacaaaacaaaatatccaacgaaaatcactaaacagcagcaatattcatcgaaacaatggctactggagacgcaagtgaaagttttcaaaagtaccgttacgacccttctaaggcagctgccatagccgtatgtgcaacttttggcgtgttatttatttcgatgattattatgatagctacgtctgtaagaaggtttgacaaaatgagtgccagtaacaaacgcaaagttaggaacttcaccattttgagatttttaccatttttggtaggtattgccatagaagctgttggatacggtatgcggtacatgtctgtgaatgataccgacaagttgacgccatacattctccaatctgtatttcttcttgttgcgccagctttgttcgctgcgacgatttacatggtatttggtcaaatgttacattatctacaatgtacgaagctttccatagttcctgcacgttggagcacaactatatttgtgattggtgatgttttaagtttctttgtgcagggtgcaggtgccggtatcatggccaatgctgacacgtcaagtgaatcaaaaactgggtccaacatcatcgttgttggattattcgtgcaggttgcagtcttcggttttttcatgatcacagagctacgtttcttgcttcgagtaaagcgcactagcgctattgttccgtacctttcacttcactggagaacgctcaacttaacacttctgggcatcagtttactaattctgatcaggtctcttgtacgtgccattgaatttattcaaggtaataaaggcttcattatcagtcacgagtacttcttgtacgtgtttgacgcgctaatgatgattcttgcttcattggtatggatcgttactttcaaatttggagacatatttaagatcatttatgaggtcaaactccttgattctttcaaggagaagagtggtgatgatgccagctatatgcaaactgaagcttttgataaaaagtgaacaaaggcccaagtaaagttcgtgtatgtttttgaaatggactttgatatccaagtatgatattgtgagacgaatttttatgtagttgcagcagatacataagaaacaaattgaataaatgtcatattactattttctgactaattcttaaaggattatccgatcgcgatattttgactaccaacatcagcagtcagaaattgttccagtactgaaccacgattccaaatttgcaacggtgtacagacagtatactatccccacaaatctagcatatgccagtaactgtacccatagttagttccacattttgtgatgaccacactttttgctgtctatttttttacagccaacctgacagatgtcaaaaggctacgtatctttctttaagggtctgtagtcggacagaaacctctgcgtcctcttacaggtgccgatcaaaagcattttttcaaaccttgtaaaaatgtcttcgagacatattctttctttccacaaagtcacagtgatgaaagtttaagaccgctcaacggccatgaatactaccagcaagtcaaacacgtactaaactagtgtaacaccaatctcataattttaattttgtcttcaccgtaatacttcatttgtgagagaccccgggagttactaattttgaaatagataaacacaatgagtctttgcagagactctcaagcaatgtgggccaataacccatactgctgtttcaacaatttaacaaatataaagtcaggacctctctaacagatgatatgtgattctgtgtggttgttctttcttatacgtaatatataagatttaaagaattatcatctatagaaaacaagcaaaatacactaccatgtctgaattgaaaatagaaaacgaagatgctgaagtagtcgataaagatgataaattgcaaaacgggaaatacaccgaatttgagactagctcagattcaattgataaaaaggaaaaaaaaattgatgtcaaagatgctgacgaacttcttaaatttatggacaaatacgaatctaccgtggaaccacttactgaggaggaagagaaaaagtttgttaagaaaaacttcgctgctgtatctctattaaccattcttgttacgttaatccttttcatggataaatcaacaatcggttatactaccattcttggaatctatacagacacaggaatcagtaaaggcgactttaacaacttaaattctatattctacgctgggtaccttattgctcaatggccatgtcatatattaatgcaaaaattgcccttgggaaaatatctcgctggaagtattttctcctgggcaataattgtagggttgacaggaatctgtaataattatggtagtttaatggcttgtcgtttttttttaggtgccaccgaagccgtggtggttcctgcttgtgagattacccttggtatgttccttactacggagcaacgtgaaattgttcaaccagtgttttgggcagctacagcagcagcacctttactttcatcgttcatttcttttggattgatgcatacgaatacatccacttatccttggagaatatttatggcaatcaatgctggtttatcgttgatacttgccataattgtcttactcctctaccctgataaccctgctaacgcaaagtttctgtcaacaaaagaaaaagtctatcttataaagcaagtgcaacggtcaacggaatcatcaattgaacagaagacaatcaaaaaatatcaaatttatgaaacattcaaagatccagtttcatggttgttctttttccaaagttttactcttatgctgtcaaattcattgacataccaacagaaccaattgtatgttgatatcggtgtcgacaacctaggatcttcattggtttctgcggctgggagtgtttgggacattctactgtacttgatattcgcttttgttatcctcaactatccaaatcaaagtggttatattgcagccggttgtctgattctaccaattgcgtccagtattgcgatggttacaatagattggtccaacaaatatgcgttgttagcctgtatgatcttagccggctcctcaaagggtatcacatacattattgctttgggatggacgacatcatctgcagccggttataccaagaaactctacaggaacgtaatgtttatgttggcatatggcgctgcaaacatcatttctcctcaactctggaatccaaaggatgccccaagatactatccatcctggattattcaaattgtggtttcattcttccttaatattgttattttgttaacaatcagatacattttggcgaaaaggaacaaagaaaggtatcaatgggttcaagaacatccagaagacaactttggtattgtttctttcacagaaggagtcaacgaaagagttaatctagccatgctagatcttaccgattttgaaaacaaaagatttatctacccactatgagttacctttagtaggagtgtataattttgggatggagcaactatcattctgtaaatcgttcgtcaatttctacaaatttacccaaagctctgttcttttcaactgcatatatccacatttctagaacgtcattttatggaaatattgtatatttgaaaatggggcatcgctatgtggacgagtacgaatagagcctttcacaatccataaatagctccaaagacacataagcagaaatttcttgtgttatcgtggaagctattactatggctttgttgatcctgcatatcaaatagcattaacaagccactctttcttttaagttgctgaaatatcagttaataactgtcagtccaattatttcctcaaaagaacattgtcttgctacacttcactgcactatcctttggtccttaggatcaattatataagcgccaaaataaagaggtaatgaagatcagttttgaaattggcgataacattttatttcggccctatgctgtgctataccatcctgtctctaagacagttcctaatattatatcattgaggccattctgttaaggaatgctgtttttttttatattgattccagtgcatgttgaggcaggagtaaggatgtgagaaatctagtaaccttcttcgggtgatacaatgcgtatgtcggctttctgcttttacagtacttgattgtttaataaagtccttcagcttgcatgttgttgttatagccgagtactctttatttgtagaatacacaatcacgaacatcaagcatagtatgcattgcagttcaatagcaaatttcaatatggtagatttctaaccatttcattcagccagaagttctgttagagataagtttacgatgtaaacattatagtactattataatagcatacattaaaactgatgtaaatttcagatttcaaatgtgcgaaatctgtcccacatacctcctgagatctactggcatatcagaagtcttatcacgacttattaccaactcgtatttctttaaatgcctaactgcactccaaacggccgatgaattgttaaagatgacaatcttatgttcaatagacgatagctgtaactttaaatgatttcctaagtgggcaacttctggtaaaactaacattacgctgtcttttgatagttcttcttgccaattttcgatcttatcgaacaagtcttgtgtaagaacgtaacatttcgactttggttttacgtctcttatattcgggtttcgctggccacgatacagatataataaataacctacagttactgccactgtcgataataccccaacagctataatcgaaagcttcttttgccgggcttgcttcataagggacttgtttagccaattggtggtttccttatctcctcgcatataatggcaatgaggtttctatttatgattttgattccatttcacttgtttttataaacaatatatcagtatgtacaatacataaataagtagaaaccagagaaccgtcaacatcttgaacccttaatctttcggcaacccacaatgatagattctcctattttttatgcgacgactgtccatttggatcatattgtgacggctttgaattgtttaacaccttttggagtgaaaggtgaaatgctcatcaccatagataaaaatggtttgtcctttgcccaagaaaacaatcatgtaatcaagatccaattggttctttcacgggagttatttcaaacctttcactatagcccgataactgaaacatctttgaccaaggtatccctgcggcttgaccatgtattggatagtttgaatatcagtaacgatcggaacgatataattgagtgtactttaacatataatggggatggatccccattcatattaatattcgaagataacatgatcactgaaagcgtcgaatactcaacatatctgctcaaagacttagacaacactgggttggtactagatagaacgcgactgcaattcgaatgcataataaaaggggatgtcttacacaatgccttacacgatttgaaggaaattggatgcaaagattgctatttttatgcgatacataacgaaaccaccaaaaagcccttattcgcattgatttcaagatctcaacaaggtttatctaagatcatattacctaatgagagatcgattttagagaagttcgaaatatacgcaaatgattcaaccaccctcttatatgatcatccaatgataagtgtttttgattatggaatgctagacaaaatacgagccagtgctcggattgcttcaaaaatcatgatacgtagagatgtacatggtttgatgactgttaatatattgaatgaaacgaaggatatactaagacctaatgaccaggagtataagaggactagagccatttcaggtaacaatctaccaagtcattatcctgggataattattgagatatgcatgcttgagaaagctcttccagagcttccagacgtaaatgagataaaagtaatgatgattgaatatatgggaagtgaatcgcgccataatttccttcccaatacacaacaaccgccgaagaaaactgcacatgacgataaagaagaggaaaatagtgacgggtatgaagctgcttcgcaagatttgccgctattcttctagcgcaaccctgcttcgacaagctgaattaatcaggttggaattaacgtcattttaggtatagatggaaactatttgtaaacatatagataccctagaatatatatacaaactataaaatagagcattttatcaaaccaaacaatgtccatattcccatgaagaaatctgtttatgttattgttgagtatgagaaaaatgagtaaaacagaagcgttaaattggatttgaacatagattcaaaatccactcatttattgttggctgaaatgttccaaaagaatttctctttcttgggtgtcagcaccccagttcttaacaacaacaacggaagcaccgacgacctttctggcgttaccgtcacggtcgatcttacccaaaccggcccattcacctaattgcttggcatcagcaaccttgattaatggaacgttgttttcagtggccaaaccttggaccaacttgctgatggcttcttcagtaaccgattcaaccaaaacagctagttgaccttcacctctggtcaaagccttggcagattctctcaaacctctggccaaaccatcgtgaaccaaagaggttctcaagacgacctttagggcatcttcgatggtcaattcagcgactgggacttgttggacttcttcaacgtcagacatttctaatttgataaaattttctaaagtattgacttcttcgacagtggtactgctccgtgaagactttagaataacataaaactaaaaacatactaaactaataagaagaccatccgaaacgttttattcaatactcttcaacatattagcttaaatcatgggaattcaaaatataaagcttccaccattcaccgtgaaaaataactttaaggtttagcgcactatatacgttcaacacttaagatatttcagaatcaacagacgacagcggagggcagaacaactgcgtccttttctttcgctgtaatgtccaggtgttttcgtgaacatttttcttaagactagtccgtggtggcgcgtactatgttgacgtgtagatgccatatttggaaattctttagttttcttcagatttgaggaggattttggaatatgtacgggtgcaaacaaatatgacagtcactggtattttaatcttgttcaagtcttttcattaagattagaagtgatgaatacaacagcatgggtcgcgcttcgtagtttaaatatcaataagcgctatagtctagtagtcgttctgtcaactctgacgattcacgaatttgaactgctgtttgcagacagtacggatgtcataaatactttcagcatatctccgttgaaaagtccgtcattatacacctgggatatcaatcaatggtaagtttaccaatgatattgcaccacgtaggaaaacatcacagctttccgtatccgttataagacctcctaccgtccatatgtagtcttgatcgtagacgatgggattacatgatagtctcagcgcagacaaaggcatatcttccgtatattttgttctggctctattcatgatgttaacaacttcgaagtttctaattacccgagatggtaaactgatgaacgtgaaggttccatcggtatcatgcatgggatgttgatgtttttcgtcatacttgtagtctttccagtataaagaagaatccacgtctttttggctcaatcctccaattaccacggtgatctgtttattatgtacaaaagtgtgtcccgtaagaggaaattcaactattttgagctctccggtctctttgtccttggctttcaatgatagttttgtccaagttccctcatctaaatcataacaccacatatcaccgtgaataaacttatttgcggaacctccatgtattattagcgacttatttaatcttttgggactagtgctggaattcatggttcttcctggaatcatcggctcgtttacaacgggttcatcgttaatattgtcaactattttgaaattatgcattagtctgtctaacagatctgcgtccatagatttcggactcaaagagtctgtatctacgacataagatgccataaaacctctaggtaaaggccattttttgtaatagtccctcagaaatgcttcatcaactgcgttttgtggtaatctagatattattgtcactaatgcggtgtcagcaaacttcaaaaagttacgtttgccccgagataggacggtcacttcgaccttccataaatcggatatcggtatgaacttgccatctccgccttctctataaccacccataattaaaatgctgtaaacaccgggtgaacttgatgaggttggggaaatgatattatcggaactcaatgccattgatgaggatacaaaattcatcatagggtcttcgaaagtattagtagaggaattcttttcagctgttgaggatgacaatgaagaagggggagaatcagtacctgatgttgaacttctggtagatttatgggtgtgtgttttcaatgaaacctgtagatgtccaaatctggggactgtattcggatatttcacgtattttgtaggttgcgcaacaagctgtaatttggtgaacttgtagcacaaagtgtccaatatatatgcagtatcgttcaatattgctcgctttttaatgtagtattcgtttgttttaggatcaattgaaacttcgtgttttatttcaaagccaccataatagaatatatgcctgtcggttaaaatagagccctggacacaaactaaagcgggagggatctgtcctgtggcattcacttcagtccactttgttgacgtataagaaaatgtgtacaacttattacttggaagcatagccgggttattaatgattgtttcgtctaatggaggcggaaggtgttttattccgtctacgtgaaaactggataagtccggggaaacttcggagaaagaataggatggtgacattcctccaaaaatatacaaacagctatccaaattaacaatggaatgatatgttagggcaggcactctagtgtcactaaaaattgggggatacagcttagtaatagtaattggacatgtttctgaataaggaacgttgagtttgattttataggatgtgtacagctttggctccatgtccggagagcttggttgccacctagcaatcggcacccacatattttcctcacgttcagatatctcaccggaagaaaaagagtcgcagttcgatgaaaatttctgacggtacttaatgtaaacctttgctgcctcagtggcctgattttcctgagtagtgtcaatgctaaaagaatttgtggacttctgctcttcaggaagacgatccatgttccatgatgagaatctatgggatagtgaggtcctacgtcttgaagatctgctctgaggcgaattggtactttgagagacatagctatctttccgtgttgccaaagagtccaatgcttccttatgatagtaattccttaatttctgtagatttacttccctttcttccttcataagctccgcggtagcagcaggcgtattcaatgtaggaatataactagtgatataaggaattggagaaaattgtttgtattgaccatccttattgattgttttgaatgtagatgggacgtcgttccattcataatttaaatggtaaggttgatcgtttttaatggcacgttcctcagatggcctgggatcctgactaagaggatcaagagcttccatattgaacgatgaatttggagctgacaaactatgcaatagctttatctgaggttccctttattttaaagtttattcgactgttccttaattgatttgggggcggattgtaatatttattgttcgtttttctttttgtcttttgtttttcaagtgggaattatttattttgaagggcgtaaggcacggctactgggcaggattttgtaatcaaagcagtcataaattgcaggttcttgcaacatacaatgaactccttgtaagttagttcacaagatagcctgattttggatggtgaataccaatttttttttttttttattgaattatcaccaactttattgggaagaaaacgaaacggcacaaactaatatagatgctttgagatgtacataagaattgaagagtaatatgaaaatataaaaacgaagccttcagtcaaaagctgcgaggcgtgcgaaaggataaggtagatataaaacatgaataaggaaaagtgcaagcattgttccttgctgaaagtatggggaaagcacattgatttaatttcccttttttttttgtcgattatgctgtcttttattgagaattaggtatgatattagaagtttcgtagactttcttctttttcttctttttcttaacttctccaggtacaataaccgaacgagatctctttaattttgcttgattattcgaagtaactccgtcatccgaattaaaactggttgtatcggtcattataatttggaacctctgttttgtgattaattgatttgtcttagatttgtttttattcccatttctgttaagctttggttttcttactttttccgaagtagatgatatgtcatgtgttgtacccatactggaatgtatattagcgttattaatgttaattggttggttgttagtgtccggtgctcttaatgacggaattgtgagcccttctttgaaggatcccattttcggtagttcaaaacttgggtcaagtctgaacttctcacttttatttagggatagtttaggtgtcggtgatgctcgaaggtgaaatagtttctcatcgatgtttggatctctttcaggcgaacatttgacacctgacgaatgaagttggatggtggtaggggatgagcaatatagcttcgatccagggctttcattccttaaagctggtcttgaagtaggtgtagactgtaagttatgctttcgggcacgatgaaagtcaaccaatgcgctgttgttcgaagaaattggttgcatcattttggtaaacggtgttcccatttcattcaaaatccttctgccgtatggcgtcaaggacatctgttttcgaggcggagacaatgaagtcttggaagcagaattgaacatgaggtttacatcaatattttgcaatggagagtgaatggaattcatcaatcctgtgttattttgttgatgggttaaattcgtattattagtgacaaatttaagaggtgtcttggcgggagtttgtctttgttgccaaaagtttaaacctgctggtgagtccatcaaaaattctttgaattgttcaggactcgcaagcaataattcgtttgcaaaatttccgaaatgcaacacagaggaaggttgttcatttatatcaggtaagattggttgagagatgttatttccagtgattgctgttctagttgctgccgctgacgatgatgatgaggatgaagatatagatgacttcccatttctttctgttgagtttgctgatgtctggatggtagaaccttgattggaacctgtaacaatggaggcggaggctctcgaattcgaggatgacagaagcacttcaacgtcgtgtgatgttgaactatgtgtcgtaccagtaaattcagcattgatagagttatcaccatcagttaatatttgactactattgacatcgatatcattggagctagtgttcggatcaacggtgggtcgatggctgtgctggtgatgacgctggtgattgcgatgattcagcatgctattttcaaccaatgagtaatcattcaaatcggaattatccctttcaacagcgtttatatggtccagtttgttctgattaagggtgtatggagttggtaatgtgtgttgcattggttgcggactattgaaggcatatttagtaccaagctgctcttgccctgcatttgaccggtagatatgaggacttgtcaagtaattggcttcctcgtcccttgaattcatctggaaatctggtaacactggtagcactggtaataatattcttgatttattgttacggtaaacgaatgtcgttgtgagaaatgaaatgaaggcgtagttggctgcaatgtaaaaaattcaaatgaaacaaagagagatgtccagttgtttaaatataaacacaatagtcaaactgtatcttgaaattgaaaaacaaaaaacgatacagagtgtaatctgaatccaagcgaatgcttctttttgtctttaacgagaggagaaaggaaagtcacagtgctgaactaaacctgaaataaggatcccaccacacgcgtactgttactctatgggtatgacgattgatgaaatagataaacgtacagtcttaaatcaaatagtgaatctgtagtagtgttccaatgcaacggtttcgtaaacaaattccaaagataagctaactagcagaggatataaagtatgatttttgtatcacttatgcgtaaatgatggttgtttgctattcccctctgttgtaatatcttcaagcttctgggaattatatagtattaccgggtaggcagaattaaactcagttaaacgtccacgaattgaaacagttgttccatgaaatatcgatagccaggttgagagttatgctgaaggttgtcttagcttacatttgttttgtttcgttttgttttgtttttttatttttatcacagaaaatgctattaacagatgcagaaactacggggctatgagatggacccacaaagaggggagcgaaaaactgttaattacccggttacaatgcgacgcgaaaaaatatgtaaataataatgaaccatgtcgtggttatagctgtattccagccgggatctgaaatgtcagtagaaaaggttctgcagcgttttttcgtttataccgcagataagaagggctttattcgatgcgatactgtgtatccgatatacattagaatttacatgacggagttcattgaatcctcaagtttttctacgcatagaagtactacaccaatgtaaatgcagtagaaatattgtcgagaatcccaattatattactgtcgtactacagcgcatcttttcttgatagcatcagttatcgatctttctttgcagcaaacaacgtgcgaggaatctaacatcagttttcatactttttataccgtttatgttttttttttcggttttcttaaggctttacacattgtggcatgaagtcagaagaaaagtaatactgtttcgaaacgacagacgccagatgtcacactttgtttttgccgtccaatttcctactttttataggtgtatatgtatgtctgctaaatgcaattgtatcatttatctatatagttttctctttgtgaaagcgctccgcaaatgcagaaagtgcatttgagaaaaacatgaaaacaataataaaaacaagattaaattcgagaatgaaaacaaacgcccaattgaaagaagctctgctaattgttgaagtattatgagtttacaagaagtgaattcagttacagataactgtagaataccattcgttttctaaaagcttacaaaagctataggcaatttctttgttcggttctacgagctattgattgatagctctcaaatattggcgttgaatccttagctgattaagtttttatttagcattttgtgcttcatcgactagcaacaaacaagattttttgaagagatctttgcgcaagtaaaagttgacaaaggtgagacaggtttaccctctcgcgttattttacctaccggaactcctaaagatcaaatctctagatttcagtgctctatatctaaagttgagtgtccaatcgaatttgttgcaatcgttcttttattcccacgtcattgcttgtacaagcttcgcgtaccattgtaaggcttacatttctctggcgagaatcagaacacccgtaaataaaacaaactaagtggggaacaccttactgcgcagtctgtaagagttcactgatcaacatcttctcatttcatctctcaaattgatcgatatggatttagctgagagtttagaaaactttcatattacgagtcctgagaaggtcaatactgtaaagcgatcaaacggaaatttcgaagatttcatcaacagtgatgatttcgaagatcaaaacgaacaacctggtatagcaatcgaacgtccgacgcttgagaaagtgcaacttaaaaagactaaaaaagctgaacttaaaccatataaagaaaatgaaaacccattgccacagcaatttggttctttccttagcaaaatggacgattggtcagtcaactacggtacagtaaaagctttgaaggaggattcgaaaacaaatgggaccatggcgcaaaggttaaataacttggatgaaggaaacgatgctccacaggctcagtggaaaaattatttactcaaaccaaagcaaaagagtgaccaatctgcgaaagatgtatcggatttaattgtgacagcatcattaagtgatctttctttaattcctgcagatacattcaagaagaaggaaaggaacgatctcagtagtctaagtcatgaaactgatcctgcacgagaagcaaaatcagtctttaaaaatgttctgaaaaaccaaagatccaattatttcagggacaatgataccctaaccactcagaatactaagaattcaaatggtgccaaccagccatatcagacaaggaactacataaattcagacttcgagtccggatcccgtcccgtgtctggatcagaagattttgaatcgggttctgattcaagttcggattctctatccgaactgaacccatcgaatctcaactcacctagtcctaagcctagaattgtaacgaacaccagaaggttacctctgataactccagaagatgctgggttagtatttgatcatgaaactggactatgggataaacaacgtatgatagccgctgctgattccaatatatcggaaaacagtaccggctcatttgttatggaggaagattcgacaacaactaattcgaattcgaattctcattctagtctaaaacccatttcagattcattcaaacgagaccctaccttggacaattgtatagatactcaaattccggtcattgcaacggccaatagtgaaattgaaagtgggttagatgatgaatatttaggaagcaacgtaacattaaacactgttactgatgacaccccattgagtacacccaaattcaatagaaacttttatcaaaaagatacggataagccaatgactcgttatccttcttcatcactgcacaaagaactgtcgaacattcattctcagggcaccgccaatattgctgatataactagcattagccggatggatacttcctacgatcttaccaagagagaaattgtatcgagattattagagattgaacccaacccaaccaattggcagactctgtacgaagtagatctatctgatcaagcaataaaggactcctgtactggtattgatgaattattgccgaatttaatcaacctcgatgtgtctaacaatgagttgatatcgttacaaggcatacctaatcatatacaaagtttgaatatttctaataacaagctaagatcgcaacttctacaatttcaagacttaccgcatgtcgaacatttggatctttcagacaacaacctaagtgcattgcaagatcttaggttcactgctccgttgtcacatctacactacgtggacgtttccaattgcggtattgtatctttgatgggccttccaaaattcgccaaagttgatacgattatcgccaaggataacaaattgataggttccatagacttcaagcaattgtgcgaaacttctcctataccgtggcaacatgtgacaaaacttgatttgtcaaataataggatcacaaatctcaaaaacctacattatttggtcagtttgagagtgttaatattagatggtaattcgattgaacaattgcatagtggctcatatcatcaaggttctaggagtcgtgttggaaagaagattgaagtaggaaaccccgaattgcgttacctaagtatcaaagatggcggtgtccctgtacactccttttccgggtttcctaacctacgaatcttacgaattactgtggcgatggacagcatcaatattgaagagaatgcaatcgattcacatatgacaaataacaataatagcgatatagagagtcctaactacaatgcatcgttgataccattatccgaacgattccccatgtcattcccattggagcaactggaaatccttgggatgcctcattcaagtccgcgtcaaccatcaaagcaaatgtttggaacttccactaatggtagaaagcaaaagcttggttccgatccaaactcatcatcagcatgggaaggtttcgagttcccaccacagcttcgtcgggtaaccctacgctcattaggactcacaagagtcccacaaacgctcacgaataacacgggtctaagctcattagatatgcaaggtaataacatctactccgcacaaatattattgccttcactcccgtgtaatttactccgattaaatatactacagaaccctgtgctagaagaacctttgcgtggtaccgacaaaataaatactgggagcggcactaaccatgatttggtggtgcatcaacgcagaaacaaggacttactccgtcttttactccactggtgccccgcccttgtggagtgtgacctctgtacggaggggtaaaggaaatccaaatgaaagaaaaaaaaagaatagaaaatagtaaaaaacaactgaaatctatcaaaatcttatagaagagagaagtttctctcatgaagggagaagcaaagaggggcaccgcttaactggttaagtgagagtctatattgtgtttcagtagacagacagagtatctgtaatccttctcgacccctccctcctatccaattctgtcatatcaaacatcgagaatcggagcttcgaaaagccacaaaaaagaagtgttattacctattgtttaaagtgtagcttatacaccgcttgtgttctcatgtaataaattaactaatgttgcttagagctacctagataatgttgtgtcagtaatgcaatattcaaaacagagaggtccagagaccggaaataatgaaccgaatatacgcaaaaaagaagtttctccgatctcgatattgcaatctgccgaaaaaaaaaaaagggcgtcaatgattagctaacataagccagaaatacagaaacactggcagtgattgaagttttgatgtaatctgttgtattgtgtttcttttagacccctctttcaactaccaagtatcgtgcctaagttattgtgtcgggaggggaaaccggaacggaggggcatattcattagctaatatagtaaacgagtagaaatatactggagatttgttttcttagcaaaaactggtgtttgaaattcacggagtatattgaagaacaggcgcgggcagtgcagcacatctaatagtgttgctataaaccaagacaacgagatactgcccttcgttcggaagcacaactcaagtgaccagtcacacaattctagtttatccaccagttgttctcccgaaaagaaaaaaatgaaacgatattcagagtgtttctgctctcttgcgcttatttaccggtatttacattaggccacaatccaatttgcaacatttggctagtgatgggacagaggttttccttttatgaccatactgtaaagggtttgtatccacgtagtatcaacatacgttaagcggggtcattcgagttctcaacattttcccactttgcttctccatttttatgagctacggcttttctgttgttttaatcacccttaattcagacacttccttcactttagaattgtatatatacatatatatatatatatataagctatatgatttccagtttattcactcaggacgctatttcaggagatttggacttcagcaagaaaaattaactaattacagataatcgacctagttgatattcctctaacgctatattttgtaccgcgttgacaatatacattatttaaggttcagatatcattgacaagtttcccaaaaaaaaaaaagggcaacgaatactgacacattgaaaaaaagaatcggaatttcaactagacgctttgagttcaaaattttaaccataataccatattcgtctattaagaaaaccagtgcgattcaaaaggcaaaacttttcaaataaaatgttattacgtactaccactgctggtactagactagctttcaagtcacaaactgcggcattcgcacatgctttacgttactattcgcatttaccattgaaggtcaaggttgatttgccaaatggtatttcatacgaacaaccaactggtttgttcatcaataaccaatttgttccttccaagcaagggaagacttttgaagtgttgagtccttcaaccgaagaagaaattactcatgtttacgaaggtcgggaggaagacgtggatgcggctgttgaggctgcagacaaagctttcaagtccggtgtctggtctaaggttgacccactagtcagatctcagtgtttgagcaagttagctgattacattgaaaaggatttggataccattgcttctatcgaatctctggacaatggtaaagctatctcatctgctaaaggtgatgttcaactagttgttaactacctaagatcagctgctggctacgctgataaggtggatggtagagtcattgatactggttcgactcatttctcttacacagttagagaaccattaggtgtctgtggtcaaattatcccatggaacttcccattgttgatgtgggcttggaagattgctccagctcttgctaccggtaatactgttgtcttgaagaccgctgaatccacacctttgtctgcactatacgtttctcaatacattccaaaagcgggtatcccagacggtgttgtgaacatcgtttctggtttcggtaaaattgttggtgaggctattacaactcatccaaagattaagaaggttgcattcactggttccactgctactggtcgtcatatctaccaaaatgccggtgtcaatttgaagaaggtcacattggagctaggtggtaagtcaccaaacgttgttttcgctgatgcaaacttgaaatccgctgttcaaaactctttgttgggtatctactataactccggtgaagtctgctgtgctggttccaggttgtatgttgaagaatctatttatgacgatttcttgaaggaaattaagtctgcttcagaagctctaaaggttggtgatcctttcgatgcagaaactttccagggtgctcaaacttcgcaaaatcaattggacaagatcttgaaatatgtggagattggtaagaatgaaggtgctactttaattactggtggtgaaagaattggtgacaagggttactttgttagaccaactattttcgctgatgttgaagaaagcatgagaatcgttaaggaagaaatcttcggccctgttgtcactgtcaccaagtttaaaaccattgatgaattgattgaaaaggccaacgactctgaatatggattggctgcaggaattcacacatctaacatcaatactgccatccaggtttcaaacagattgaatgctggtaccgtctggattaacacatacaacgacttccaccactgtgttccgttcggtggtttcaatgcttctggtattggtagagaaatgggttctgaagctctagacaattacactcaagtcaaggctgtccgtgttaaattggagtaaattggctgatatgtagttacaggcacaaggtctgcacatgagatcatgatatttgtatcataaaatataacttacggaaatacctccaaaaagaagatgcatatcacgctcttcagctcttcttattaccgattttcgcgagtaagttgattttctggagaattctgacaatctttatatatcctgattatttataccgatttggttagctgtgtttcatactgtgagatgcagaccattatttactattggcgtatattatgatttaatgaaaatgctaaatgaaaatattctttgattaatgtcgtctttgctgccttagtacaatttggtagtgcgactcatctgatatctacatttaggctctatccaaacaaaaaccaatgcattctgcaatttttctaaatcggaaaataaattacgtatattgtctattaatgaaataataaagggttatctgtcggaattattatcaacctagaagattgtacgtgttatgactgttcttatttatcttcggaatctgacgcactaccagactcttcaacgatggaaatttccagctcttcatcgaaatcagaatcaccttgcagttggatggtcctttgcgaaattaccttggaagatggcgttgaatatcctgtggaggcagcgatttctgtgacagtattcgcggatggcccgtcggatgtttcgttttctatttttttcggttttcttgatgcattagaggatgaactgaggtcaatgccttgagaccacatcaagaactttagcatacccatgcaacttatagaaacaaccacgaccatgaaagcactgattaagaaacctttgtataaatcatcaacttggaggaaccaggcaatgaacgtttgaagtgttttgcaacttttaatcttttcatcgataagcttcaagtaatcaagatggttttctttatcaaccacattcttgtatggtgtctttttgctggattcttccgaggtatctacttcattcacatcttcagaatgagctttttccatcacgacttcaagttcctttttctccaagctcaactttggtaagaaagttgagttaccaaccagctctgcctcttctatagactttccaacgtagatattgtcgaatgatatatcgcttgcacttgaccaaatatcaaaggaaattgcagtaatagcatcaatgttcgctggtgttttatcctcataataattgggattcgctatgagaggcgccttccattcaccttgataattggggttagggatcatttcagccttccaagtacctctgtatttttcattttcaaccatctttggtctccactttccacaaccttgtttcgtatagcacgaaggattaacaataaggggagcaatccatcttccatccaccttgtcattccaccaatctggtttagaacgcgattcatcctcgatgtattcagagatgctgtcatcccattcctctggttttttgaacattggatctggaatccacttgggttcattttcatcccagtcttccggttttatggcagtgggatcagggatcatagacctgctgccccaatccgctggctgactagcagaaggatcttcaatttcccttggaggatttaggctgggtctgaatgttccctccgcaagcaagtttcctgccttgacaacttctccatcgattctaatttcaaatgactgatctgcagagtctaatatcaaggtgtataaacgagtaatcggttggtctaatcctgaaagtggtgcttctgttaagtacttgtcctcgaattcttcggaaattggattctcacgcttcaagatgaaatgtacctcattagtgtacattgaacaagagtcgggaccaaatactaagacatagtcatcggctgaatgatcatactgactgagatcatcggcattggtttttagtaatttcatgtatgcgccaccacattcaagcatcttctgtaatttaacctcgtattgcacaactaacttttccttggtcttaacagaaatctcatgatccaatttatgggcaatcgctgatcttgtttgagagctacctaataccaatgctaagtcattagagaatcccggaactaaatatggggattccaatttccataatcctgggaatgctcttgacatggtttcatcaacgtgttccatttcaagttccgaaataacccaattgtgaataaactcatcatgactgctgtactggaatgactcgaaataggagtcactagaaagctttgattgcaaatccgataaatcagtcatgttcgggtgctcgattctataatcgccctttaccataggatttatggccacagccagcgttccgaagcctatttggctcaaaagtagcaatgggttcattgttggtgctgtaactgtttctaagtggctaaagaccaataaatataacgtagtgaaaaagataaaatcgtatgtgagctttaactgtacctggccttaaacttaaattatgtgttaaacttatactttttttttctgttttgcagaagtatttttttagcccttcgagattaggctccatcaaaaacctccacagagcactcacttcgtgacagcgtagtaacttcttcctcttttcttcaccagcaagtttactattacaaagacattctcatatcaggcgtttcctagaatgccaaaaatataaatttatatgcgtatattttgtttaaatagaaaccaactcatgcttttatgcttcgacctcatcttccaaagatgcgaatgtattaacatttgagggttgtacaggtagttcagttgattgttgaacttttgcactatcgtacacttctacttcattgtcatccatggactgttcatcgccagtttctttcccattgtcttgattatcggcttggtccttttcttcgcttactggttgtatgttttgtaaaatattcagttcatctctgatttttgcatttgtagaatcccacccagccttacgtgcagactgtacgtacttggccctatggatagctctttctcttttaccatcaagcctattgttaacattcaacacacgcataactttactacttgttaaagaactgtcatcaagctgttgttttcctactcttcccaagctctttttcttgtttcttggaccacgtttattcagcttagcttccagtaattgttcgttcttattagcagttctgattagtgatgctgcaaaatcagtcttttctgttcttggtaatgtttcgagagccttcgcttctggttctgcagcctctgatcttctagcagcacgtgagtgctttgaaatgggtttcttagccatattagtctctgatgttcctggcgtgtataacctggagtctatactctagtttctatatttcctaagatccattggatgagctgagatgagatgagctactctttactttaatctatcgttattgtgtgtattttttctttttctttcccatagtgaagacgaacagagttgattcagaaaattgagggtaagcgtgttaaaaaaaaaaaaaatagatcataataaccctgaaggtgtggacttgtaatgcaagtgatgcggctttattgttatatgatctaatgtgataaaaatgtgtggtgcctttctgctgcagtgtgaatgcatgcagcacaataacgtatcttccactcattttgcattatacaggtactgtaacggtttccacgtaataagatatataagggaatatcttcagagatccaagaccctgcttttaatgttataatctgcctagatatttatatatttaaactgtagttttctcatttatcaaataatagtaatgtagatgcattttagatgcacatatgagttgataggtttttgtttcaaaacatgtgatgtgaaaaggggacaatcagggtatcagttggtggcatccaactcaccatgattattaggagtcaacaatatcttgatgtttttctctttatggttcattaattcgtcgaaccctttagtgaacccatcttcgattttttgtctacccgtaatcaaatgtctagctttatcaatagcaatgctgccattgcctaaggcttggaccacatcttcaaaatctttaatggtgtaacacatggaaccggtgacgaatttctcttgcagagtgacgtccataggtttgaaatcgatgggtttgtggccccagattgcaatattaacatacatacctctgaaggtagtagcatggacacctgtatcaaaagttggtttaacaccagaacaatcgtaggcaaaatcgaaaccttcaccacctggagccaatttcttcaaaatattaacggcatcttctttatgttcagaaggatcgaaggtttcgacaccaagcttggcagcttgatttcttctgatttcagctggttcagagactacaatcttggaggcaccatgaccttgcaaagctaaaatggtggctaatccaattggacctgcgccaagaactaaggcggattggcccttctgtaacttggagattctaacagcatgccatgagacggagattggttcgactaaggctgcaacgtccaatggtaaagtgtttggaatcttaacaacgtgcttttcactaacaacgactttttcagcaaaaccaccactgtgaactcctagacccatgaaacccaaatgggcacaacagttgtagaaccctctttgacaagcagcacattcagcatccttagcatgtgcagcgttaggccaagtgtaatgatcaagacatgtaccggtggcttctacaacaacatgatcaccagccttgatgttggttacttttggtccaacttttgatacgataccggacatctcatgacccatagcttgaggcaatccaagaccactaacatcgtggaccttgccatcttctggaaagaaaataggaccatctaggtattcgtgtaaatcactaccgcagataccacaccatgagacttcgatttcaattccatcatctgtttcgatgacaggttcctccaaatcctttgtgtatctgatgtcttgttttccgaaataagctaatgcacgcatctttgagattaaagttaattgaaactagtgtgttttcttagtaaattgtagtatgtattcttgtgtgatgattgggtacacaatatactccttaattctttagaatttaaatttggttataataccgaagtaaaagggagtggctaacaaataaatgaaaatattaactaccttagaaaatataactttggaagtgaattgaatgagaggctaataaaagagaagtgtcttcccttttatcttttcttgaagtatattatccctactccaccctccctcaaactgaacttgaatagtatgctatatttgcaaatcattccactaacattagcaaaggcaagttccgtaatcagaaaaaccgaggcatgcgtagtgcacacattaaaaattacccagaaaacagcaagaatgcattagacaacacgacgtgcaataaatccacagaggctgctagaaacatcactactcacatcaaaataaagggaagaaattatgcagcatgggatacataacccggaacacggcagataaaacacacgtgagaggactgcagacaactatctagggcttcccttgcgaatctcatcagatgagaaaaacgacggaggggcaggacaaagaccacgtaagtgagtataatttgcactttaatttgtccaattacactacattgtttacatcgtatcggtacaagtcatttcatctgtagtgctttggccataatcaaataaacccgcacctaatagaatcaaatagatcaaccaattgggttgtgttgacccggatccacgcgataactgccgtgaaaataaaataaaaaattccccagtatattcttgattctacatgattcgttttttccgacagattgcttttctatttacctgttccttttccctctatttgtttccagaacgtttattttggtgcatcttgtactaaatcattgagacaggcaacttgtactcgaaaaattataattaaaactaaacccactaatgagaacggaaaaaaaaaagtaaaatcgtttgttgaacatgggcaaacatggaaaggtggatattcaagtcagtacagttatccttcgttgttctgctgcccactcatataatgcgtatccgcgaattttagcattgtttgccgatcaaaagtggcatataccatgaacaaatgtcgatgaagtttttccgtgatatacctagcatcgggcgacacaatttgaaatgcacattttttatattctctaattggttcaagtaaggatccagctgtcggttggtagatttgcttttagcggctttaatttcttactatagtcatacgtcactgtcaacagagctggaaaacatacctatcacatgaattgttgcttatgttattagtggtgattcattcatatttttctgcaaaaaaaaggcaaagatcgggcaggaaaagaaagatcaagaatgtttgacgcagagttttagttcgattgagaacagaggctcatttcaaagtgaatcatcacgtaaggacaaaaaatgggctccttttcgtcataatggtatatgtatttggatgggtctataaatcctaacgtttcagcgtttttttagtgacattcttcgttgtcttcttgctatcaactgtagaacggcttaccagaagagctttgttacggataatatgtgtttgcgatgggagatgcagcctagaaacgcgttttcttgtcataccagttagttgcttaactcacaaattcaatgcagccgatgattcttttactccgggacagatcgttttgagtttcgggctttgtgttgctttatatgcatatgaacttgttatgtgcttcgctagctgaacctttgccaaggcatgcaatataattctagcgcagataactattccgagaagtttctgattgggaatatagccgaagttgagatcgtctatgaattcaaggagagttgcttcatgttagttcatggcacctacttgttctcagtcacctgacatgggtctcttttgaattgaaaacaagagaaatcaagttaatgacccatacacatcaatattataaaatgtatgtgccttgtattaaacggcacactgtatgcgtgcatacagatcttatctacgatccgtttatatatggtttaatgtgtttcaatgccgtttctctgtataaccttgtcttcgtgacgagtccgcctactttactggcaacactctgacaaatcctgtgccttgttttggaatttataacacgtgaataactcaagatataatggatgaaaagtggaatgcaactttttgcatgaattaacgaaatgtaacgattcttcaattgtattgctttgctaactttttcaatgatatacaggagattaagaatctaattttttttcggcccttagcatctagacccaagtgattaattcttcctttggagtaagtaggatcttgatggttccttctttgtcattgatcaatctcatgaatgcgtcttccattccattctctagtgaaacttttcccgtgatcatgaaagccgcttttttgaaatctgttttaccttcggtgaaggaatcaacgacgtcctcaaaatcctccaatgtgtaacacattgaccctgtatattttttttcctgtgatgttaaatccattggataatgcttcacagagctgtcaccccacacagcaacattgatggcagttcctctgaaagttagacatttgattgatgattcgaaagtgacagaaatacccgaacaatcaaatgtgaaatcgtatccttcaccatttggagataatgaacataagtttttgatgttttcctcattggtcttgaaatccatagggttggaaacaatagcacccattttttcagctagatcacgtctaattttggcaggctccgaaaccacgatatcagtgcacccaaagtgttgcaaagccattataatgcccaacccaatcggaccaccaccgagaatcaatgcagattgaccttctttcacagctcccaatttcacagcatgccagcaaactgctaaaggctgaatcaatgctgccacatcaagtgggatccatgatggtactttgaaacaatgtttctcaccgataacaactttttcagcaaatccacctgattgtacaccacatccgcataaccctaaatgcacacaaacattgtgcataccccttttacaagctttgcacgtttcacccttagtattatacctttctctgtcctgacatgtacctgtaggctccacaacaacatggtcacctggttggaatttagtcacactagagccgacttgtgaaaccacgcctgccatctcgtggcccatggcttgaggcaatcccctaccactaatttcatgtgtttcaccatcttttgggaagaagtttggtccgtcgaggagttcatgtagatcagtaccacagataccacaccacactatatcgatcaaaacatcatccggtttttcaattactggttcaggtagatcagtggtgaaacggatatctctggttccaaaatacgctaaagcacgcatgtttttgtgttattactcttcctttgtctatttcaaaaatcaatttccaggaaaccggttattcaacgaagtacaatggaaagcttgactcttgctaaatggaattgatagcttttttgttcacacagaaacgttctaaagacagtaaaggtatgattcttctgtaattgaaagtaatagggcctgagatatctctttttgtaatagcaaatgagggactaaatacatgatatttcaacgttcattatctcgactccatgaaaaaaaaaaaaatgagcgtcataaaactgcgggttcttgtcggtaatttttcttaaaatcgtcaacctgtgttctctgttaattgtctatggttacttgctgctacatgagataaacaaagtacaaataacaaggctacagcaaaatgagtttggcattaaaaaaacaacaaatattctcattaccgaaaccaaaaacaaaaacaaaatgtaatatcctaacaaaaatgctagtggtaaacggataagaattctctgaaaaacacagcgtaaatccgtcactaaacccggacctatgcggcaacctgaagacaagaattttctatatacatacatatgatgacataattcttcgaaaatattaatagatgcaaaggggcgaccagtcctgaatggcaaaataggagcttgattgaaaaaaaaacacaaatacacaacacaaaaaaaactcagagtgttcatgcatgtgaactgggccagctgtaacagtagctaattctcctatccactaaattgataattggcttcttattctcgagcctgtgctcgatgcttgaaagcagttgttgcactgaggataagttttcctagaaaacgatgtagtcatgtaggagaggagaaaaggggatgaggagctgaaaagcagccatcaagtaacaaccggtacgggcacgtctacgctggaattgcacgagaacattcgaagaaatataccagccacccgcgcatgtcgggaaagaaacaaatgtcattcatattaccttcttttgaatttggatatttcttagttccactgagcatatacgcaagggggaaatagggaagagaaaaaaattacttgtcagaacgaatgggcgctgaaattctatttcgttatttatcaactacggcattttctggtagctccttgtttgcatgagggaaaattagaaagaaatgaggaaattctatgccttgatcccaaccaaaagttaccaaagaagctcaatgtaatatacagataacaccgtagcttgtcgacactttaagcagtgctatataaacattacttccaattcagtaattcttgagaatttctttacatgagcatttcggtgttttcatcaggaaaattgactttgaagtaaagtcaacgatgtgggtacggtatgttttcgtctttgaaggatatacaggttacttaggaatagacaatggtattctcaagcgtgtttcttttttagttacatatctacctgagataaccgttctctgtcgaagaggtgattaatgttatttttgtgggtcgaaatatcagtgccgttggcaccagtcacagtgtcggaatgattccaaacatcgtgcagaaaccttgtcatcttcacgccgacgtaactatgagcagtttctgccattttgttaatcaattgcaagatataatcttgatcttcaggatccgtgcagaatgaaccggacactaacatggtccaggaaagaattccccatatctgatgtccctctggtatttctttgaaatgttgtataatttctttaacgcattcttttacgggggacgaatgtgcgtcgaaattatcaaagtcgatcatcttggaagcaaatagataacaggacttagcggttagtaatcccaccattgaattgatgcggaaattgaaccattcaatctccttcatcggctgttcgggcataggatgcttgtattttatgcatatatttcgtagttggacaactttcaataaccatgtagttgtaagcggcattgagagacgtgcaatataagataatttagcaattatttcgaatatgtctagacatgatcctagtaccggattcttcatccattccaaaacattctcgcaattgtacactgggcaactcaatgccttgttcaattctttgaaaataacaaaaggtgaaggcaatttggatatgtcttttgcacatagtaccgaaatagaataatggtaaatgaaactctcaacaaacatccgttcatgcggatttattacacggttatcgaagtaccgatgtgatattaccttatatgagtctgagaggaactttactgagtcatcaactgttccgaaaaatgcgttcttcacccggatacatagcaactgcgttgatccaaatatccaatcttcattgtaatattgaggattggccgacatatagtctcgtaacaaattcactgatgatacaaaataatcatcactgaacctttgaaaacggtcaaaatctttccatgcaaggaatgtagcaccgcaacatagaaacacttgtctcatgataggattgaaacttacaaatgggacaaaagtagcaccaacagttaattctggtgaagtatattgtgtgcctaattttggaatgaatccggtcaaacatgtgtaaaatatgaaggactctaaatcaactccttggaaaaatgtgtcatccaagatctcattcctatggtatcgctgtaagatatcaatataacgtttttcttcttcttctgttggcgtttccaactcatagggtgggattgttaatccatctggaatatcaacaaagggaaattccttaagctctagatctaatggcgcaatgctgttccaacattcgtctttcagcaaattcttttcatgatatttaatgtatcttgatgttgagtctttgggtaatggtggcagttctcttggaaacttagtaatcttctgcagctttttaccgtcatataaatataactcatcggatcttcgtttcacatagacctccattcgaagatcagatgtcctcgtgtatttaattctatgtttcaacttgagatgagtgatattgaacttggtatcttcgctttccacctgagaaatcttcttgccgactttaccatcttttgtgttgctactgtttggccatatacactctagaaagtttctcttgcaagctgtgcaagtcggcttgacctcgtcgcatttcttctttcttcttctgcaaattaaacagcctgtcgaacttcttttctttatcaccatagatagaagtaaattgcaagattaactattccttgaaatgcgtgtatattattaatgatgctcccatttaccttctctgttgatgttcatctcgcagcgcaccttcatatatcctgaaattgaagatgacatgcgaattgcaaaccaatctttcacccatctcattattacacatattgctgcaagtcagaaaaaaaaacgtataaactacatttaccaaggcaatgggcatgacacaaaagaaattaaaaggtagctagctatctacataatatagcagtctcatgttttgtaaattatgaaagtcaaaagaaacatgttatagacaagatgagggcaacaagatttgctggatcgtaggctaaggagatattttaacacttttgacaatagaactagttttaaaactgaatgccatttattaatatataaaggtaaaacagaaaaaaaaaggcgccttcaatttcatattctttaacagttgtagtagtttctatatgagatcggtccttgttgtcagaaacaggttggccttacaaatgcaagcttaatgcatggatttcaaatcctaaatttatataacaatttaatacatcttggacaccattacatattttaggcaaggtgataagagcatgtcatttcaaaatcattcaattaaaagtttgggtaaaagtaacatacgtagtgacggggtttatctaaaatctatatgtgcatgcgtttgtgcttgtattacattagaaacggaattaaagttcatttttaaatttatgcttttctaagataagaacactcactttagaaaacatcaccttggtgcaacatagcatcagcaactctgatgaaaccagtcaagttagcacccttaaccaaagatggcaaagcttcaacgttagattcgttagaatattcctttgcagtagtaacacagtcatcgaaacaagtagtcatgatcttcttcaattcagcgtcaactgtttctctggtccatgaaactctagcggagttttgagccatttccaaaccagaaacagcaacaccacccatgttagaagccttacctggagcgtaccagacggcaggagcactagcggaggcagtttgcaaacgaacaccttcgaagacatcgatggcttcttgagtggaacccatattagaaccttcagcaacgaacttgacaccattggcaaccaagtgttcagcttcagcaccagaaacttcgttttgagtggcacatggcaaagcaacatcaaccttacctacgtgaacccatggtctagcaccagcgatgtatttcacagaacttccagagaagacagaagcttcaccaacgatttgttccaaagtcttccaggctgctctaccatcttggatagcgtagatgtgctctgcagtgataccagtttcggagatgacagaacccttagaatcggacaaagacaaaacggtagcacccaattcaatacatttcaaagcagcatattgggcaacgttaccggaaccggagatgacaacacgcttaccttcgaaagattccttaccttgggaagcatacttgatcatagcttcagtgtagtaaatcagaccgtaaccagtagcttctggtctgatcaaagaaccaccccagttcaagtccttaccggtcaaaacaccttcccaagagttcttgtagtgacggtatgcaccgaacaaataaccgatttcacgaccaccaacttgaatgtcaccagctgggacatcaacgtcttgaccaatgtgtctggacaattccttcatgaaagcgtaacatactcttctaatttcggaatcagatctaccctttggatcgaaacatagaccacccttggcaccaccaagagataaaccagtcaaagcgttcttgaagatttgttcgaaacccaagaacttcaaaacggacaagttaacggttggatggaatctcaaaccacccttgtatgggcccttagcagagttaaattgaactctgaaaccagtagcgacttcttgttcacctttgtcattttcccaggtaactctgaattggatgattctttctggaacagagacaactggcaaaaccttcttgtagacaggtttcttgtcgaacaaagtagagtctttcaaacagttgtaaacttcgttgtaggcttgttggaattctggttcatatggttcagcagacatctttaaaagttttggtatagtattagttcttattacttttcacaaataatcaatctatgatgaaagtaattcgtactgtatcgtagcctaaggtgaaatggtaacagaagttttaataaaagcactgtaatcaagaagtaaaaagacgggctggattggaggcaagagatgtaaaccatcgtgtatttatataaaaaatggaacaagtcaactaactaccagttcatatgcgttggtcgattaaaactgtataactgccagacgtcaagatagccacaaattacaaagaggagcagagatactgaagaatttttgaatcaatcaccaatcaaatacaggatgggaccaattttttcttttgcgatatctggcaatattcctcttccttttcttcttcttcatctgaaataatgcttccatcccattcaaacaagagttaccgatcgaagcatccgtagaaaacccactgggcaatagaataactcaaaggtcactttcgcactttccgatcgaaaaagtaatgaaagaaagcgtattgttgctcaataagccttgagctctgttcaaatactttcttttcgctaagataaggaaattcgtgataacaaataggatttcgttttcagctcatattggcattcatatccgggtaattactgtttcgaacttgccagtactattcccagaataagaaactaatcagaaaatattgtaggaaacccttccgttaaaagtatcattctcatattaatgcggtcctagaagtaaccgtggaatctatcaatgtgttactgaactaaggcagtctaagcgtttcggaaacacactcgaccgcttctaaattgtgtcagcggacggcgaaaaacgctatggtgggggaggggacaatcagttagcacatttcctccaatcaaatggtggaaatggccgcgattaataattgcgtgatacgctcgaaactgtccttttgggttggtattcagtctttatcttttctcatttacggtgggatttatgaatatctaggcgacgcactagaaagagaaagaagtacagaaaataaaccttatcgaccaatcagatcacagaacgctcctgttacggcccggttttcttgttgccaactgaattgcccggtcggcactttccgaatttcttacaaggagaacgccgagtgaaaaaaatggtaaaagagcacaaacggatcgaaccaagtagggtaaatatacacgtgatacaatactgacgttacccagctatttgttttctgtcggaaataaacaataattgacgccgttgaacggatttgtttctttataatattaccctacctgcacgtgctaccaagtcttataaaaattccgagatggtgttacccgtacaaatttcggggtgtgttttgtgccaagattcttataaccaaattaagaaattttagggtgttgaatttttggatggtttattgattttctttgagatgagttcggtgacggaaatcctgaatttatcgctgagaaagtatgtagtaaagctaattctttatactctttccagcttaaattgataccgatgattacgaaacgaagccatgtgaagtagtcgccagctgtttcgcattgtttcattcttccctccgattctcttctttttattgaatttcatctcgtgttctgcgtaagtgagtttaatctctactgtgattcagatatactggaggggaaaccactttggaatcagtcttattcccgctctgctttcacaaggccctgaatacgggtgtcaagttgttaatactgaacgctattaggttcattctgttattagagtgcattaattacaatagcggaatacattttgctgcagacgtggctgaagaataaacttcgaataagagtttaccttggtgtcggatctacatttgtgattagtctgagcttacgaatcaagaacttctctctattcctacagttgatcaaaagtataattatcagtaaggaaatttgaagttgctcgttacactacagctgaatcctaccttgagcacaacaatcaactccagcaaaggtggataataaattgttcccgctcagcctttcaaaaacctttaagctgccagatcaaaggacaaatttcccttttcaatgatgagctctttcaaaagtcctgaaataccagatgctgaggtcagacttataacgtgtaaccttcttgctggacaattccaatggggctacactaaatccgaaaatgatgggttctttggtgtttgctgtggaaactatttaccattcgcacagacagtaatgcaatgtttcgtggatttattgcaaggagacaaagtcgcagcaataacggaatatacaacatactgtaatgcttatactggtactaatcttagtattgaaaattctttagagcagttcgcaaatggtagtaaccatttgatatcaaatccaggcgctggagcaaactatgtgcctattctgctttcttcagacgttttgaagcagaattattattttttctattacatttatcataatttcaaactagcatttgactgttccatgatggtcaacatcagcatctggataataatatgcctacttgccattcaaaaaagattaaattgccgtttattgagaaaagtacgatccagattcacttcaacgatctcaacaacacatcacacagaaacaaaaatcttcagatggtatttgacaattttacccaccatcggagagacctggttcttgttgattttccttatcatcaatgtccttgtcagcacgattcattatccgctatacgaatccaatactggagaagggaaaatggtatttttggtgaagtgcgttgccaatagaactggaggacttgcattcggtctcctacccttaacggtattacttgctggaagaaacaatattatcagttcattgactggtatgccgtattgtaccatgatattctatcacaaatgggcggcgagattaatgacgatattcggatttactcacggtatgttatggtctggatactgtctgtggaaagaggccgagcttttggccaactatttgaaaacaactccgctattcagatggggggtcataatcacagatctttcaatcattcttgtacttacatctacgtatatgtggaaatcgagaagatacgaattgttcttgacgttgcatatcgtattagccgcagtgttcttttatggttgctacaaacattgtgaggaattgggatggttaggctggatctacctctcggttgctctatgggtgatggatagagcaatccgattaatcaaacttctgaggtttggaggcatgaagctagcttattgtactgtattagattcggaacacgaaatattccaggtatcgataccaaatagtggtgccatgcggttcttccccggatgttacgcatttttgtacgtatggaacacgagattattctggcatggtcatccattctctttaatgaagaatggcactgacattatcatcattatcaaggcgaaagacggtatgacaagagaactatacaacaaattgcccaaggatgggactatttatccaatccgggcggccctcgaaggtccttacggccacgaggctcctgtagaaaattacgaccatgcattattcgttacatcaggaacggctttgccaggacccatctcgtacctgcaaagaatgcacaatatgaaagacttccactttgtgtggatcatcagtaacgagaggttcttgaactacatgaggtatgctctagaatcattgctgcagcaaaagaaggggaatttcgaaatatacatcacgagaccattatcaatcgatatatcttgggtcccatcaactttgagcattcaccatggaaggccactgttggaagacatcatacaccaagatctttccaagtggaaaaactctgtagttgtatcctgcgcaatgccgttcgtcgatgatcaagtaagaaattacgttgctaaggaaatgcagcagggaactgtagatttctatgatgagctgcaagtttggtaaactgagagggtttttccctagtttctcttcacatctattcattttctgtggtatatttagcaagcactatatagaaaaggacgggacagctcggccaaaaatggtaaatattcccaaaacctttaagaaagcccttgaactgaaagtagtgcgaataactaaacgcgtgattcactttaatcgttagagactcaaatgaagatggcaagaaaaaaaaaactagctcggagtgcaaaccatattcagtgtcttcgaggaattgattccatatcacaagtaaaaaaagaaaaaagaaaccatgcacgtcaagtgtccaactacaaaaagataaacctctttgtggaaccccccataatacgtccttatacccccaaaacctagttaagcatataaccgaccccaaaaacttccgccagaaaaaaagtcattgtgacttgtttctttccactccatatacagggctgaaagaaccacattttgaaataaagcacagaaacaatcgtaacccacagatcttaaccttatttggctaagctttccttccactgtgatgagacatccaaagacataaacgagtggttggccgttactgaaccagtttcattcaacacagcgaatagaagctccaagacaagatgctactctggggaaatctatgatagcgcaccacactgtgatttcacacacttgcaagttagctactgaagagtacgtgtttggatcttttctttcggtttcttgtccggccttgtgggatagagttacatattacttctgttggtaattactgctactattgttactgagatgagtattttatgttctgcatggagtgttgcttcaatagatggactatgtgtaattccgactggggcgagaaaggtggtaacgagaagttcatataaatataaagtatcaccgacaagtacggatttgtcttattatgtgctctccttccaatgatctaattctgtcgcaatataggtcaaactaattataaaatatttccctcgcgctgagatacccttatttgcaaccagctgtttgttaaaacctgatattataaacataagtatcagaatagtatttattagtgtgtcatgaccagtttgaagagatctttggaaccatttaacgtattggaagaaactattccaggcgttcaccaagaagttaagagattcaagaatgctaaaaccgaggagctttatacttccctggagtatgtgcctcaaacacaaaaaggtttagtagtttcttcgttcactgaggatttgaaactgttgacagatttaccagtaccacagaagttaaagccttatgagattttgataaaaaacaaatacattggacttaaccatgtggattggaagagtaaaaagtacagatttagcatttactctttcccatgggtcaatggtagggaatcttctggtatcgtggttagaagaggtgaaaaagtagatgaagaaaaattcccacttggtggtgaggtattcattgccagtacaacttacagagatctcagaacgtcaaccttccaagaatacacagttttcgattcacgtctggtatggagagttcctgaaaggatagggcttgattttgcgtctggtattggcgtcagtttagttactgctggcgcagctttggcttcaaagaggaatgtgaaagttcaaccagaagagaaaaaatccattgtcatctggggaggttccactggagttggtatatttgttgttcaacttgccaaaagccttggatttaccaagattattaccatcacttcaaagaaacacgagcaatatttactttctctcggtgcaactcatatcatccatcgagaagaaaaaacggaagatatcgttaatgagattaaaaaaatctgccctaacggggtctcccatggtgtggatttgatttcgaagaagactgcagaaactctctccagtatcttatcagcggaaagcaaattagtttgcgcagcaggttgtccgaacaaagcccaagtgaacgatcctacaattaaagttgaagcaatcaacctaaaattatttcatgaagatttagattacggccaagagttcgtcagatatacaactgagttgttcgaaaagaataggctgaaaccattatctaatttgaagcttttcaaaggcttagaaaatttctgccaaggtatcagaaatggcctcagagaacttgaggaaaggggagcaagtgctgagaaatacgtcgtagctatttaattgcaaacagacacacagacacacatacactttacttatcccgattaaagaacacacatattccatgggcactggtacccattaaagacattgtatccaaccatcgcatcttctggccgtttttttcattcacttgtataatatttaccaatatatacacattagcaatgcagaacacagtcactaacgaatacagaccaataactttacaacacttatattacggctgtacaagttcagccttattcgactgagtttacacatttcagccggtcgtgctttactattcctatcgtaaacggttctaatgtttttctcttccatgctgcttaaaagttgagacgacagcataatttcttttctattgtgaactgttcaatacggaccgcataaaacaagaaagtaattgacagtgtatctgacagcgtatcaaggaaatgcattatcccaatattcagttatgcaactttaacatctaaagctagtagaagaatgcacttgcttcagtaaaagtcaattgatggcaccgtttgtattactccgttgctcttgttaattgtgtaatcgtgtcgtgccctctactgttttgacaaaatcggatgtttcaagcctacttattcatccaagctgcttgacacaaaagacttgaggctaagaatatcagagtgacagagtgaattgatcagaggccaaaagaaaccgagacttcactatttactgtcatgtctagcttccttttttttttttttttttttaatgcctgagaaacggaatggcagccgttgatagtaatttacagatacatttatagagatatacaaaaattactgattaatttagaacagccatgtgtttgacacagtagatggcaaaaattaattacaaggccccttgtataggccgaaatacttgtgaactttgctcgtgcaacgatttgcttgtagagtataaattgtgaaaattatcaacaaggcaatcaactactccctaatttatagtgttaaccccatactgttttccatttagctttcacgaaggaagaaaatagaagccagtaagatcggctagggcgtctgctacaatttcacctttctgagttagagttccttgaaatacctgtcggatagaagaatctgtaattagtgcggcgtattatttggcaacagttcctcagctttaaagttaatttgaagcgagatttcattttggttagagtaaacaattcagactcaatatgaaatttggtaagacgttcccaaatcatcaagttccagaatggtcccatgaatacgtgaactataaatcactcaagaagctaatcaaagaaatagtggctgttcaagatcaattatacaagcaggagcatcgtgtcgatgggaaagatagagaaaatacgtcagtttcaccaccgtcgaaacctatggatgtcagtacaagaaccaaagattatctgaatcatccggaagtcaaaaccttactggcaaaatttttctttgcgttagacgccgatattcagaaggttgactcattttataatcaacaatttttggaatatgatcgtcggttgaggaagttgttatcatcggctcagttcactgaattcaaccgtgctttgatgtatggagctgcaaatggtaacagtggcctaaatcacactgctgggaatggtaatgggtgcctatctcagcccatgccaacgcgctataatcgtcatcaatcattgacacaaaatggtcatcctggattccatgtgaacccagattcagtaaatcacctcatgctatcctcaaacaaagccactgaagaagcagaagattggagcgaagttttagcaattctaattgaactaaggtcgcattttagaaatttgaagtggtacggtgaacttaacaaacgagccttcagaaaaatcttaaaaaaattggacaaaaaagttggtacttcacaacaggaaaccatcacgcaatctagaattgcacccctagaattcgcaaatgacacggaaatcaacagagacttgcacatcattaatgagctattgaataagatttttcctaaggttaaatctttgcaggctgaaacgaatggtgtgtccaatacatcgaacggatcgtcagacgatagaaattcacccttggatattttttcccaattgattgctcgagatgatggagagagtttaatgaacgaattgatatccgtatataggtcggcagttttaattccaactagggcattagtgggtttgttaaacaaatccgctctttcccaatcattcaaatgcatcgatgagatattgtcaataatccctactttaggtgatccaacagatatttccagtaggaattttttccatcatcatgttatcgctcttggaaaatcccacaaacagattaaggaggagtcaactaaatctcaggttgacttaaactctttgatgacaaaaacattagaaatcgaggctgcattacctccagaaccaaaccatcgcttggtgggtgcttttggtccggatggaatcaactctaatgattccccttcttccttacgttatatcttgcaaaagcttccggtgcatctaagacctagccttttacaaaaagataattacaagagaactccacttcattattcagcccagtacggtttagtagaaacctccagaataattattgaatcattaatcgaatggggtgcatggaacgcagatataccaattgatgatgtgcatgtgtggggtgattccgaaggattaactccaatacacctagctgttattggaactcatcctttgaccgtaagaattttaactagccatttgggtcctgacaccaaacttaacacaccaagactacttcatttggcgacaagattgaactctccagatttgattgacgctcttttaagcgttcccggtttcgacattaattaccgtgatcttgatcatttggaaactgcattatatttggcttgtaagctaaatcttagagaagcagcagaacatctattaaatcgtggagctgacatggaaattggagagaaattatttggatggactcctatatttgttgcagcaactgaagggttcacagaccttgtaaaggtcctcaaagagcatggcgcgaactacgatgcattagacgagagtgggtggtctccaatggaacatgctgctttacgtgggcatttggaaataactgatctgttaagaattgagggtaatgaagcaattaccaatccaaagattgtaactgattggaacgtaggcggcgcttctgaagatattaatgataagaaagaagattcaccaacagtcgatttctacaaacagggaactactacaagctcctcaattgacataatgactgatggaaaacctgttacgaatcctaggaaaatgttaacacattcattaagtaccgggaaagctatctcctctaaggatagctcccagcaggaatccgaaacggtgaaaaagttcggacacagctatttaaaatctaatgaatccattattttaatatgcttaggtggcaacgataccagatcgacaaaaccagctgtgaaattaaacaaagttccagttagcaaagtgtcgtctactgaactagataccgccctttcattagtcataagttgcccagacacactttccgaagagagctttgtgcttgatttacctttcgattctaattcagactcaatcagttttaaagtgccatacaaaccagactcatcacataaaatcatcttcgatattgtgccaacttatggatacaccagcagtagtaggtcggtttctcccaatgcaaatactgaattgagctctgacaaagctgctcataacaaccgtggccgggagcaccagcagtatcgtgagcattccagctttcctggttacccaacctcgatgagtccaatctccatgttacatgcttatagcaacccgccacacgctggtaacaacttcttatctcccgaaaagccaaagattttggggagagctgttgccttacttgatacagctttgacttctgttggaagtaaaatgcgttccttatacgaaactattacggttccaattctaggcgttgaaaatcttgatgttctaggaacagttaacttcgaattcatgaacgtcacaccctttgagaatccccatatgggcttagctagaagcgaaaagtattggaaatcattggtttccactcgtgttattgggcatcgtggtcttggtaagaattttaacaccaagaattctctccaattgggagaaaacacagtggagtcgttcattgctgctgcttctttgggtgcttcatatgtagaattcgacgttcaactaacaaaggatcacgttccggtggtctaccatgactttcttgttgcagagtctggtgttgatattcctatgcattctctaactttagagcagtttatggatttgaacaacgccgataaacaccacattcatcattcttctggaaaagttaggagacgttcattggacgatacagatgcagcaattttgaggagatcaagattactgaaagaaagaggcccttcactaaaccatatagagagcgataagaaggatccaaccaacggtgctgctggaatatctaacaaagaggatagtacttcttctgaaattaatcctaagagtgtactcgaagaaaatgaccgttttggtaaaactgatgaaatctcaaggctctttgaagacagaatgcgcttaactaaaacttttaagaagaatgccttcaagggtaattccagaggtcattcaattgcatctaattttgtcaccttgaaagagctcttcaagaaaataccggagagtgtcggctttaatattgaatgtaaatatcccatgctagatgaagcggagtccgaggacatgggaactgtggttcttgaacttggacactgggttgatactgtgttaaaggttgtgtttgacaatgctaatggcagagatatcatcttctcctcgttcaatcctaacgtttgcgtaatgttatctttaaaacaaccaagcatcccaattctctttttaacggaagctggtacgactccgatggccgatattagagcaacctcgttgcagaatgctattagatttgccaaaaaatggaatttattaggtattgtgtcagctgcacaaccgattgtgaaggcaccaagattggcacaagtggtgaaatctagtggcttagtttgtgtcacatatggtgttgaaaataatgatccagacaatgctagaatcgagatggatgcaggagtagatgccgtgattgtggacagtgtattagcagtccgtaagggactcactaaagaaaataatgaaaaattgtaaaatagcataaacatatattcaataatgaacaactaaaattacttagtgttaaaatgatcgtcttagtgaatatctttgccaaatcatatttaatacgactttcttctttgtttctcttcggatgcttgttcagtttcaatcgagagtccgccagaaaataatcgtatgcatagatctacgtttgaatataccttatatttcacaatatcgggaagaacttacaatgtcctacaggaaatctggtcttcctctccttgcttaagaacacatacaatcatatcatagtgacagaaattcttctcgcggattgaggattagaagcaggctgtttagcaacatcatcgacaatgaattgattactgtgagttgcatcatgaacctgaccggaagaacccaatgcgtagccatgttccccactgtttttttcatcctctgcagccaattcatcaatttcatgtaggcagtcagtatcttggaaaatatcagctgctttcacctttgtttccggcgtttccgcaatcaattgcaacgtcttagtttttgcatcatcgttaatgtggtgatattcatctgggaatgctagaatgtttacctgcacacctttcaacgtcaaatatctgtctaacgtagcattgtttaaatgaataggaatgttagatacgatcaagctatgagacatggttgcaattgaaaaagacttcagtatcacttcgttgtgccaagaaaaccttttaactctgatggtttgatcttcgaatagataaaccataatcagaatcatgtaaaaaattaaagatcacagagagaataaaggggagcatataaaagcgtataatatatatatatatatatattctgagagagacctagcaacgacgtagttaactggaaattctgtttgtgaacgactgttctgcggtacctatctgtactgcagtcttttaagaattgagccgaaacaagaggacactatagacaaaaagaaaatagacaaaacgcagactccaatagaacgtaatctggaatttatcagatgaaatacccaccctaattcctttgtaacaaatgctctgatgtagctatttattacgttagttaccaagaaatacaactccgtgcacacattcttccttttttcttttgcactccatcccgtttccttgggaaacccaccctttaaaagtgtaccaactagcacaaaatcacagataactgatttctatcatgacatttcaccaaaatgcctggacatattgatcaggagaaatggatttaattcatccccttccttcttacaaagaagtagcgaaggagctagaacaaattagataagctattatatgaatatccaggctaggtagcagttgttacaagtgacccattaattgctccacccttatttcttttgcctttaccattacgacccgctatttttactccttttcacgttccttttcaaacgtgttttctacatactagctggagaagagcagtggggcaatgaagggccggggtcaagcagatgttactgttgatgtttttgtggctaatgggactttacctggtcagaaatagaccagagggaggaagttaaaatcgatatttgttgaaacggatcataaactatgatcgggtaactaccaatgtaataggcggttaagtatcaagatgatatgtaaggatttctagttgaaacaccattaaccaatctgaattattatataaggaggcattagatctggacaaggaccatcaacacagtcatgccagaaccccaggtgcatcaacatacattactagatatatagctaataaacactatggattcatcagatacaaaagatcttgaaataacaacacgtgactggtaataccagtatcaccaacaatattaatgggttatttatcagtcacgagactttagaaaggagttcatcaggaatgggatacgggttttatgattaaagatattcaatagatcattttagttgggattatttattgctcatttctgagcttcattatatatgtacaattttgggacggccttgaaagcggaagtctagctttatagtagagtttcaccaagagcacatcttgcaatggaacaaccagttgtgatagtatctaccacgtgaccatcgtgagaagccagttccgggttgcattctacgacatcaagggctactagcctaccagtttcagcgattctctctaccaagaacagcccttctcttaaagtcaacccacctcttactggagtaccagtggctggtacgtataatggatcgatagcatcgacatcgtaggaaaccatgattggttcatcaccgtttggtgcaactttttccaaagccatttcgatgactttgttcaaaccatatctgtctacgtgatacatggagtatgaggcaataccgttatccttcaaaatctttctttcagcggcatcgacgtctcttagaccgatgtaggcgatcttctttggatccaaacattttggaacccattttaaggatggaggagtgtttttagcatcaaggcccatcaagaaggagacaggacaaccgtgaatgttaccggattcagtagtagaacatgtgttgatatcagcatgagcgtcaatccataacaaaccagcatttgggtatttgtccaagacgccagccacggtaccgatagcgatcgagtgatcaccacctagggtcactgccaatctgccttcgttggaaaccttcttaacggattcgtagattagttttgtggcttctccaaccaaatttggtcttttcatgattccataaacatcagtttcatcattcttaccagattcgaaatctctaccttttagaggttcttcaagagtagtttcccaacctagagattcgatatctgatctcaaaccttgtttcattaagtatttaggaccattttcaacaccagattttggttgaccaccagagaatggagctagaacaataccaagcttcttttgttggaagaaatcaaaacgtggatcggatgacattatgtatttgtgttgtgcgtgttataataaaattctaaagatcactcaagaatacagtatgtatatcagtgaataacctcttttcgacttgctgagtattatatgaattgacgctaatcattggacatatgaaaagctgttatagaagtctaacttctctcgaagggaaactcggttctttatatacttgacgaaaaactataacgatcccattcagcgaaacatgttcgagaaaaaattcgcccctgttaattcataataatccgttaagtgcttgtgtataccgatgcttctcctcttcatctctttaccgttctcttgttcctgcacttaacgacaataaactttcctttgacgtattttaccgattttcctgataataatacatagttaaaaaacaaaaaaaaacaaccatatcctatataatgaatcgccaaacaatatgttggaggggacaattgctaagggtttcaggctagataaacgtttatgtgtgacattccatcacatgtagagatagaagaaagaacatgcctcgaaaattgctactttgacggcgattggacggcaggacgtgaaaagaggatgagtatcagaaaaaggaattgttctcatctcgagataagaatacatgtcagtcttgatttcgctctctttgggatcggtaattatcgcgctgctaagcttgacttgatgatctatgatataatagtttgtatgcagcatttcgttaagtgataaaactagcgaagatcgggtaacggagaaaaactaatgaacgtcattttttcatagttattgtgagcgatcattttgaagaggtatttcaagtcacgtgcacgatgcctatctatccaatgttggtaatgtcatccacaatagagcgctgagtatgtatcggtgatcaatctttttgccgcgtactggtaggagtattcaaagttcaaaatatcggctttttgacactaattccgagcatttggattatccagtaaacccttaaaggcttcgagccttcattttttttgttcccacagctcagttcaatccgttgatgacttcctttggtgtttaaactgcatagtctccaaaaattaaaaaaataaacccaaggaaaaatgtaaaacacagaaaatcttaaacaaaacaaatcaaagctgatgcagataactgacgagtcatagattattgcactatattaagagtatcctttacatatgccaatgctgcattaatcagtcgaaaaatatcccggcaataaatagagtcagcaaatttggttccttttcctagttcagtggtgaaagaaaaggatattactgtcttcagtcattctgttgtaatttctataatcatcttgatcctgaagaatcgactacttaaggacggtgatagctcataagaaaatcattggctcgtttacacaattcagaataagtcgatatgaatgacgatttttatagaccgcctaatatagcggatgtaagcatcgaaacggagggatttgaaatctcagcacggaatgattcaatgatgatacagaataattcacatacacctacaaagttgaataacttagaagtcactgttatttccagtgatggtggaagtagtggtactaatgccagtgaaaagaatggtacattatctctatcagcaggggaaagcacaatgggtgcaacgagtagggcggacagaactgtgcataattcctctaaacgtagtgacagtgttaagttgatcaaagttatgaacaaggttgatattttgaaagcagttttcgcgacactaacgggtaaagatcgtatagcgaaaatattcaaatatgtgatagatatactacgaattttcatacagaggtcaatgtattacaataataaagatatcgacgtggatgcttatctgaaattattttcaaaaggcaatctgctcacaatcctaaggaatccaaggctttcaggtaaactcttcttatctagctcttcgaaattatttctcgaaaagggtgctttggttagtagccagctaggtttctataggcaaatcatgagatgtgggggtaccccattcagactttaccattggtaccaaaagctcataagcactttctatgcgtcccaaaagtcatcaactttacattctaaaggtctagtttggtacaaaaattggtggaatgaggaatctctctcagagttcatcgacttatattacggaatcatggatgaattgatgctattatacaaacttaaactttggtctaataaatcgatgcatgcctgggtttctaaacacgaagctctctcatggtattacgacattatgctagggttgaagaaaaattgggagaaacttcaatcaatcaaacaacaggaatttgaattgaagatccagtatcaggtacgtcaacgcgcattggaactatcctcaaaattaaatgccaccccatctgttgattccaataagaatacagcacttataaaacagactatcttcgagagtttcaagcaggacaacctagatttagaactggaagtagtacaaaaactcaagaactaccagtatgagaaacgcattgtcaagtttgatctgactagactattctttgatttcctagctgatactacagatgtgttctctatcaaaacaccacctggtacatatgccattttgtctctatgctctggtgtacttggattctccaagctatggatacaggcgaaagagcaaccaaatgaatgagtaacataccctttgaaaatgtgtaccaaaaatttcttagtacatttccctgtataactcacaagtaacacaaagtatcaataagctacagacaggctatattttagtgacttttgcaatgctgcttaaaagaagtgctcaaagacatataactttacatgggtacctgattaagatccgatttggacggctttgcaagcgatattatataaattattctatgaattatatagtgtcagaaggttagagaataatgaattaacatcaataatgattaggagatatgaacataaacctctatgatagaaagtaggatagaatagaaaggaaaaaaaaatattaactttagaacctgaagtaaagagaaaaataatgcaaggagacggaactaatggaaatggataattaccattcactttctccctgggctttctggaaagcaaagtctttatggtctattgtcactacaccttcttttaaattacacttccacttatttttgactctcagcaccttgtcatatagacatagcatcatattgacatctgtgccctcatcctcgacgtccatgttgacatagtcgtcatcggagtcatccaaatcagaattgatttcatcggtttctaataacgcggatttcttggcttgctttgcttgtaatttcagctgtttagtcaaatctccatctggatcattcatagagaactctatttcttgttttggtttcatttcattatcttctatttgcagttcatcattattcaccatatctgaggacccattatttatattgctgccaatgatatctgcttcaccggcactagcagcagctccagaatgatttatggaattatcgttgaattcgccgtttggtagtttaaccacaggctcggcaactgttgatgcactggttgtattttctgggtcccaaatgaatgtggcggctttgctttcacttagtttcatctgccaaattcgtttgagatcttgcaatgtctgttcatccactcccgaatcttcaaattcttgtctgacatcgttgataacagtctcgagcacggtttcatatacctttgatgcctcgatattcgacatattggaaaagtacttgaagagtttcttctttctctaataataacaaaagaattaaagaccttattaagccgtttattctaaaagctattccgattccgacccggtactagaaattaaaataatccttcctttaatcgttaaactgaaatccttatataataggataccgtaagttaatttatagaggaggaacttcaatcaaagttccaaagtgttcagaaaatcagtttcaaaatatggagaacgatagcgcttttctctgaaaaaatatctattgcacagtttccacccaggtttagtgtccgcttcacaagtagttcagctactgatgcggctggtttccctctcctcattgacactccatataaggtattgttattattcagatttaattttccagtttccatttcactgaaaaaataataatatgaaattatatattacccggatatcacgtactcagcttaaatattcagtgttcgatatttatatggtaaacataggcatagtaaataaaaacagtaacaaagcttcattacgatcgataagtgtgttgtcacaaaaggccagatccatatcgtcggtgccacgatctgaagttcaatattgtattactgcttcaacgaaatcattgcaaagcaagacagacaccacttacatagtttcaaagaggtgctaaaattgaggttttgttgcgcatcctatcgtttctcggcggataagtgaagagaacacgagtacagcacctatggatttcggagataaacccaagctagagtttgctggctctggtgataagcttaactctcctataagattggttcctgatgagagcaacaaggaaaacgtacacgcattggaaagcgatgatcaacagagcgataaggagcagacctacaagagaagtaaaatagagtactcatccccagaaaagattgagatgcttaatagtttatctcctataaaaatagatatcgaaggaaatgatggaattgagtctgatttgaaaaaatcagtcgccacagccattgaagaagcagtgcaagatttcaaaaaggattcaaaagcggaagaagatgaagaagaggcattcggcaagttaaataatggatttcgtggttatcatgaatcctccactgcaaacgcttctggatcagctggttctgatgcaccacaacatgctcactgccatgagtcattgtcaccgataaggtcgtatggtgataaagagatgcctctcgacccatcagaccccacagtctgggagaagaagtttgatgatttatcatccgtaatatgggataaatatgaagagattaagtatctcaatgatactgtacagaacttacgagaaagaacagtagaagcggaatttaataaagagagagacaaattggaacttatcaaatgggagcagaaatatggcgacgtattatcaaaactgtataggagtgagcataaactcgaacagtttgatgaattgaaactccaatttgatagtgtcagcaaaaagttcgaagcctgcaaacaaaaattgaaagaggtcaaaatagagttatctatgacaaatcagaacaaccacattctatctgagaagttcgagaaagaatataccaaattcactgagaatgaaaacttggtcaatgaatggaaagataaacatgattctttactattggaacttaatgtgaagaccaaggaactcaagtcaattaccgatgagctacgctcgttaaaggaacaatatgaacgaaacgaaaacaagttgtctgaagttgaaagtgaaatacaggagctgcgtaagaaaatggaagaagagacaattgtattccaagacacaattaaacctagagatctaagtataaccgagctaaacaaaaaattacagcaatttgaagcaaatggttcagatgaagttagctctttgaaaagtaagctccaaatcactgaagcagaattagatagtaagaagaatgaaattgagtcattgaatttgaagctcagtacaaaggaaacagcattagaagagcttaggtcacatatcactcaggtcaccgaggataaagagaaatcattatctgagttagagcagaccaaaagggacttagactctcttacaagcagaaacggcaacatagaatccgaacatttagcagaactagaaagattacacgaaaatatgtcgcatatggaaactaatctgaagcaaaacgtcaaaactatcgctaatttaaatgaaactgtcaacaattttgagaataaatgtaaatcattggaagcagaaaatatcgatttgaaagcacgtctaacacagacagaaaccaatgttaacaaatcagaaacggatgaactccgagctaagatccagaaattggaaaaaatggttgcagattcagaagcagaaactaacaaaaagttgcaattattagctgaagatctttacatccaatactcttccaaacacgagcaaaaagtcaagatgctcaagaaagggtacgaagccaaataccaagacctgttggacaaactaacagtcgaaaataacgcattgcacgacgaagtggatcaattgcaaaaagcagtggaaatagagagagcggaaaaacaagagctaataaagtctcttgacaactaatgtgtgtgtatatgagtacgtacctattatagatcaaatatactccggagaaatctggttttcttactatcttctcttccattcgaacctttccggtggcaattatgtatttgctttcgttttgtttttccgttttccagagacaagttcccgacgcatgctctttccagtatgggacactcaattcgtgagcatttcgggatgttgtgttctgcgccgatctcagcctataatagccgcactttaccgaactactgatatcaaggatgactatggggaacaaatttctcgaatgaatgtatcctttactaatgacataacaatggattgattgataaataaaagtgcatcgcgtcctcttgtaattagcagtattttagttatcaatgaaaaacttttcgcctgcgaggagtaataagattgcatttctgaatgtggtgttgcaaatccgaatggcactttatcgcacttcaatcgaaccgcggtcatggaaataatgaatcatgaaaaataaaaagctaagctttgactgtgacagatttttggaggtacatttaatgaaaatatgactgctacatattagagaagaccatgatatgatgtttcatatataaactataaatacgtagtcttccctgacggaatgcatattctcacagaatattacaccattgtcacaagcattctacggctgatccggttgtcacagaaaatatcaattcgaaagacagtacagcgatagaatattgtaatgacaatgactaccaaattcaagattctcattcccagaaagaataagaacgatatcgcttctgactcagcagaattccaaagaattgcagaattagttgatttccaatattatgaattgaccaattctgaagatttcaagaaatttttactctcaagcaatatcgatgctctttggatcactgaagaaatgtttgtgtatttggaagctccatccacgtatttagactatttccctaaatcattgaaattgattttggttccatgggttggaacagatttctatgacgcgaaattgttgaaggaaaagtacggcatcagtttgtgtaatggcggtccagtggcatcagaaaacgtttctgatttggcagtgttcttgacattgagttgcttccgtttgacgtccttctgggagcactcattcaggtttgttcatagaggtagcatccaagaatgtcgaggatatatcggaggtacacaccatgatactattcctggatttgcgctggttgaaggtaacgatgacttgcataagacggtctctgcgcaacaaaagttcccaaaaaagcctgaaaacgacaagttcttgaaccttgcgaaggattataagatagcgggcaaagtaatggaatcaccaacagataagaatgcgttgattgttggttttggttccattggccaagctattggtaaaaaattgcatacaacttttaacatgaatatatcatacacaaaaagaaatggccctatcccagaatctgttctaggatataaggctaattatataccatccatggatgatgaagcgttctggagagacgctgatcttatagtactagcattacctggaactccagacacagaagatattattgataagactacattggaaaaatgtaaagacggtgtgcgtatcgtcaacgttggtcgtggatcttgtattaacgaagatgatttattagatgcattggatagtgggaaggtcatgtcagctggccttgacgtctacaaaaatgaatcggacgttgtggattcaagattcttcgaaagatgggatattaccttacttccacatattggctccacagtcatagaaatactccaaaggcagactgctgccacgttagagaatattgaaggattcttcttgaaaggaactggcacaaaatacccagttaactaatgttctgaatatcttcaaactggcgctggaaatgttggctaacaatgatggaaatattactaaaatgagatgaaaagtgtattgatactgcataaccaccttgatatcaaccactctttgagttttgaaggcctactcgttaaataataataaatccgaatatatactgcattacataatccaaggcggggatcaacattcattaattaactgctcccagcaggcgttctttctaagaacagagactgttggctggtcgattataacatctacaaaagatccaactcattattaccgccaactcgtaatatatccatctctgacagaagtcactaaacgcgttacaagccgtcttcccttcggcttcccttttatgtcaaggacattaaattttagaaaccgtgaaaaattgaatatcgcgtatcaaagaatatttttcataaaagctactttaatatcgtaacgtgtttatcattcaaatagcgtcgtgataacttgaaccctatttatcaaacagtacctagtatcagtatctgaggtctacggagtgatatattcttcaattttagattttgctggtaaagtttggggtacaatatatgaagagcttgaggatatcgttttatctttaagagtatacccaatcttttcacaatttagaccatcaggacaatacggtgggcagaaacagctctttctctgactctatcgcattgaatcctcatcgtcaggtctttgtatcattgaagatggagcaatttaatgactcccttaaagaaactacatcatcgactttaaagcttttggagcaatatgagaatcatattcaggagaaagacagaaatttagattacatagaaaaaggtgactcgaggtttacgaaagatcgcgaaacaggacctagttacgacgaatgttttaaagagaacgtgaaattgaggcttaaagtcgaagaatacgaaaaggaaatcaaactgttaaaggaactgatatctaaactcaaagagaatgctgtacctgtagtaaattatgaacaacagcgattagaagtagaaaccccgaaagatcccacattttcgttaccaccaagatcagcagatagaataagacatatgaaggacacttctgaacagagtcaggtcaacgtctacgatctaaagctgcctaggtcccctgccaccttccaattaaataaccaaaatttccaggaagaattaaagacaaacactcagttcgaaaaagcattgaaaaatgatcatgcgtacgagtcgacgccggcaactgctagtaccaaaaaggatccccaagatgcgggaaaagatagtttagcaacgacagggataccaaataatattctaggaagtccagctacttccgtgacttataccacatctcgaatatcgataaattccaattcaccgaatatcaacaataaaccccatttgaaaagacccaagtcaccagcaactttaccaaatggagctttatctccccagcgagcaaatcgtgtcacacacttgattaacaatgaacttcattctccattaaaagaccagttttcagatgtagataaagatttcgttgatgataccgcttccacgtctggcgatgatatcacagggagctttatacaaatgtctccagcagcccaaagaatcatcaaagaggatgagacaattatggagttctctccttcatccaagcagaatttgaataaatttactgacttgatcaataagacctttggggacgatgatagccaaatcaaaggaccccccgaaaaggaatctgcagctgcagtaagaccacctgtattcgatccgccgcttcctagggccgattcaaaagtactagcttctcctgttatgattcaaaacgcagcaaataatttaacaccttctgggctttcctttccgcagaaaactgacatttctactcatgacttactgaaaattgtctcacaagataacgtctcagcgatttcttcaagcacctcaatccataaatctttttcacccaaatctgtctcctcactttctcgtatccaaccaccaaatcaccacacttcatcaattgacatgggttctccttataatggagaagtaccgcaatccgacagtgttttacactcacccaacatcatatctgatatacctctatttgtacaaccagaagacttttcaacaatagctgtcgaagcttctagcactttgtacagtaatcctgaggatgcaagcaagtgtatactctgcagtgtcattgataagaaatcatctaaagagatgttcaagtttgcgaaatctctggaccagttatacgagcttgaccatatgttgaaaataaggctcatggagcaatatcatctcccggaactacctaaaaagcaactatttcagactactgttcctgttaaagtcgatttgagaagggagttattaacagattatttattagcactctttgaacttagtaacctatcaccagtgatgtctctaaaacttgcacaatttattagtacagataccgcaatctccgtaccaattggaatgactgacagcgtaaaagaaggggtacttttggtacgcaaaaataaggcgttgggtagcggtaattcttggaaagtacgacaagctgtaattgaggatcaaactttgttattattcgatcaagaaaatctagtggagagcatcaagttggtaagtagtacaattgaattacaagcgaatttacctgatgataagtacggcactaaaaatgggtttattttgaatgaaccaaagaagagcggtctttctagcacatccaggcattattttggcgctgaaaccgccaaacaacgagaagaatggatcagcgctcttataaaagtttgcagcaactccgttgcaaatatcaaagcagatactctttcttctgcccaagatcaaggaagtatcagcgatgcatcggtagatacaagcagcagtgctgcgattggaccaatggttaacctcgaaatgcttggtaaatctcaacaagtcgaacctgcaacaactgaaatggatagggaaaccaaaaggaatagaatgaggtcctttttcccattcaagaaaaatcaacctcagctttcaacttcttccttagatattactaaagaatcggacgaaacatctgctgaaaggtcttttgctagtgctctccatggcatgaacctacatgatgaggcaatttccaatgttgtatttggatccgacatcaaacactgcctaagcttgagttctagagtataccaaaacactcacgagataccaaccgttgtttacagatgtttggaatatttgtataagaacagagccataaatgaagaaggtatatttagattaagtggatcaagtgctttgataaaaaccctccaagaacaatttgataaagaatatgatgtaaatttatgcgaatacaacgcttcacatgagggcagtttgaagaatggtccctatctagatgtcaatacggttgcgggacttttaaaattatatttcagaaggttgcctcatctaatattcggtgatgacatgtacgaagagtgtagggtgattgctgaaagaaattcaggaaagccaactgaaactgcattgcagttcagagaattggtatcaaacaagagatttgaaatggaaaattattcattgatgtttgttttatttgagctattaatgaaaatcaatgaaaataacaaagtcaacaagatgaatcttcgcaatctatgcattgtgttttctccgactttgaacattcctgttaatatccttcagccttttgttgaagatttccaatgtattttcaatggaagtgatccagtaaacaatgacgatagacaaaatatcaatcttcagattcctcaaatgtaatataagttaagtaaactattgtactaattttaatgaacgaaaaggaaacgagaactatattacagaagaagataaaaaaccttccaaacaagcagtacaaggcaagcaattgagactattacttgctgttgtttatgcatggagttgagataattcgcacgaaaataaatatattattgtatagagaaggaaaaaaaggtatatacataggaaccgatagtaaatatgagggggggtatgatcagcttctagagaatgctaaattcttgctctactcctgcctcttagaacattttcaataaatgattcaccagctttataagaggatctaacaagcggaccagatgcacaatataggaaacctaactctaacgctttctgtttccaataatcgaatttttctggcgtgacgtactccacaaccttcatgtgtctctttgtgggtctcatatactgaccaaaagtgatgacatcacaaccgatggcacgaagatccttcatggtttgcaagacttgttcatccgtttcacctaagcctaacatgaccgaagtttttgttaccagagttggaacggttttcttggcgcattccaacacgctcaacgattgtctataagtggctcttctgtccctaacgtgtggtgtcaaagcttcaacggtttccatattatgtgcgtagacgtcaagtcccgagagagccatgactttaaccatttctaagtcacctctgaaatcaccagataatgtttcaaccaaaatattgggcgccttttgctttatcttctgaacagtttctgccaaatggtatgcaccaccatccacgagatcatctctatcaacggtagttaacacgacgtaacccagaccccatctcgaaatagcttctgcagtattctctggttctgtcggatccggtgctgaaggtttccgattagtcttcacggaacagaatctacaacctctggtacaagtatcacctaacaacatgattgttgctgttgcctttgacttatcaccaccaccccaacattctccgatgttgggacacttagcttcctcacaaacggtacttagtttcaactccttcacgtcgtttttcaacttatggaaatttgaacccttggcaatcggcacttttaaccaagttggtagcctttgcacttcttcactgttctgccttgccttttctaacggatctaaggtaaatttttgtgcattaccgttaacaaaatcttcaaaagagggccctttattcaacttatctgtgaaatgagtagtcttccttcttctagaaacagatggctgggtagaccttaccacagtttctgtaatgaaccgtttttgtaccgaacgaattcctggttttagcattatctttactattatattcgaatgtgtctttccaccaggcagcgttcagatcgttcccttatcccgagtttcaaaggtaataaaactccaaaagacacacacgcgagtccaaagttgcgatactacacagagagacaccaggcgcaagaaaaccttatcagagcaaatgtctatttctattccctatgttttctgtcaaattcatcgtatatgtcaattttacgtatatattatatataaaattaactcgaactagtggaaatatttcaaaatcacagcatcaaactccagcttcatcacatcgcttattccggttgaacaactggaaacgacatggggcagacaagtaaaaaaacaaaaacaaaaagacttggaacgagataatagcgtaatcaaaggtcacgtgaaagaataatcgttacccggattttattattatcccacgtccgggtgaagataagtattcgcgtgggttatgaggtaacgtaaaatcagagaagaggtagggtaatagagatagagatgatacgatatgagatataaggctctgatataatattgttcttacacaagaattaaataactatgttcaacgaaataacctccttataacaaaaaaacccaatgagagactaccttatatagcttgcggtatccctcttaacatataatgcaaaaatgatatttcattgtgacttagtttcgaaaagtaaatatatgatcagtgatagcagatgaaactactactctcaatctatttagtgcatgtgcaggaagaacctgaacagttacaggtagatgaggtagagccactgcatgaacaaccggaagaagacattgtaattgatttatttgtttgtgttttagtttctgaaacttatccgtttgtagagttttttaagttgaatgaatgggtgttcaaaatgctcaaagtagtttccagtgtgcaaagaagtactttaagggactcaaattgctctgttatatacgtttttctagtagatatgtttccatacgaatcaccagtttaacgggtgaaaagaagaaaagaaaaaagaaagtagtttcagtagtgtaaaaggggggaaggaagggattcataaaatgctctggtttcttctggagaattatttttttcgtcagcgtttatctcgcagaatttgtcctagaaggggcgttgggaaacgctgatgcgggaaaaccctaaaaatacaattcaaggcttaactaatggcactatgaaggaggaaagatgagaaaagacgaataaagaaacaacgaaaaaaaacaaagaactatcgcatagtgcgtttttttgctgactccttaaaaaccgaatgcgattttccatgcctcgctgagtcatgctattccagaagataaatctgtcaatgcaaaatgagcgatgttgatgatagggctattaaataaaaactggcgaaatagacccatccccacacatcactgaagttagagaatattgtacttcatactgaatattatggacactagagactcgctccagagggttagtagagttaacattgatcttgaactttttcgacttcctgctgtaattggtaatacttcgagttgagagtgaggagttggtttactaagtacatcatttaagatgatcccttcggcgtgatatagtactttatatgttggactggatattcatcatgtttggtagtagggtcttggcctagagggttagtagtattaatgtaattggatgccattctgacttgtaattgttaatgaaataaatggataattaaattggtgatcgactaattaagtaaattacttacggtgttctccttggtttcttacatctgacatataagttaatgtagaacagtaattcatatgtcgtcaaatcctgatgggaaaattggatgaagaaaccatctacttatatacttttcagattgggcttccaatcaccaaacgctgtagccttgatcctagttcctctcagcttcagcttcttatctagcattggttcaataactggcgtcttagaagtgctcgtacaactccagggaacaacactatatagaataacaggcgatgctatcaacgcgtcaaatgtaaaaattggatgaagaaactatctgggtgtgtgctttttgaagtttttgtaaatcaccacacccgctttagccttgaattcaattcaccttttttttttcagcttcataatcagcaatggttcaatgaatagcgtattaaggtttccggaatttgcacgggataatactaggtgttatatccttaatcttatcaacattggctccagccttacagcctctattaaatgaatgaggcacggcccataattttcaagatagtatttttttttattatatatggataaattatagaaaagattaattataagtaattatgctaatgtactcttaaagttacttcccgattaaagtggcgggctagagatcccgcacaacaaaaaacttgtcagataagttaacataaaaatctggacagaggtaaggtagaagatccggaatcagaggctaagatatagtattgttcatatatatctagatactaaatagccattattcaactcaacaatctctatgtttaaaaaactcatgagcgcatcatgtagtagcgagtgctcttcttaactatttcacaaaaaaatgtctcgaagtaaatacaagtttaggactagcagatgcgaattctacccaaatcctacttcctacatgtgcaaatagaacctgaacaatcgcaagcacatgtggtagatctcgaacagtcgcaggtacacaaggtacaaccactgcatgaacaaccgtaagaagacattgtaaccgatttatttgtttgtgttctagtttctgaaacttatctgtttgtagagtttctaagatgattagttttaaaagtgcttaagtagtttcaagtgggcagaggagtactctaaaggactcaaattgctctgttatatacgtttttatagtagatatgagttccattaatcatcagtttaaggaaataaaagggaaaaagaaagtagtttcccctcaattacatagtatgtaattgaagggagggcggagcatatgtactttaaccttcctattaattagtatatgaaataccagcggggagaaggaacggggtttttatgtgctctggtttttcccgatgaactattctgcgtcttatcatttctcctacaatcggcgttagaaaaatcaggtcgcgtggaagaaatcccgataagaaggattaaagttgaacaagccgcattatgaagaaggggcaagatgaataattaataacaataaaaacaaattatcactaaaagctttttcgccagcttgttagatatccgtcaatgcaatgtgatggtgttgatgttagggctattaacacgtacgacattaatacactattagttaaagcgtagatcatgacttcggagtttcattaccacctgttggagcccccgttcttcgaggacgatgacctggtctttgggcgtggcggagacccatgggatatcattgatatatcgctatcgtcaaagttcagtaaccttgagtgtctattgctgcgcaaatgacgtgttgttgtgtttgacggaatcttgtacccgcctacgttggatcccgtttcctgcgtcgaggaggaattgctggattcagagacgtttctgctgtttctctgatggctgttgacgggaactctggtacgtgcacgatgactttgaccgttgtcgccatgatgttcttgctcctgttcctcttcgtcttctttcgcttgtataatgtctaacgtttccaaatgtctcgagatatcgtcaattgtaatgtcttctacggttctattgaacgtcttgttcaattcctcatcgtaaatataatcttcgtcttcctcgttctcttcatcgctgggcagtatctgatcaacaaacggtacgttttcatcctttggttgttctgaaggcttttctctgcgcacaggagtaggagtctctgttcttgggatctcattctcatgcttgacaatcgtctcatggtacttggatctggtcagtctgacttctgggtgagtgacagtatcctctgtatcgaataacactttctcgaattctggaatcatactgcggccaagcatgatgacctcttcagcccagatccttattacgtcccgagctttctttgtcttgtatggcttccatcttggtttacaacctctgataatctccttaacaacttgttcagaaccccactcgctgatccaattctgattttggaacccaatcaagtgtgaaaagacaccagatgcaatggcaccgtccgaataaccaccttccatgactgaaatgatcttaccgttagaatgcatttgggccagttttaaagcatccttcgtaaatagattgtagaagcttgttgggacattgacattgtgcctttgcatagattgttgttcgtattcactggcatcaaatccagcactgatgacgacaagacctttgaacctaaacccaccttgcttcatttcaagttttgcgttcttgaaaaactcatcagccttggcaaagatagatctgtatttggtctgataaagtttgacaaactcttcttcgtctttatacgactgtagatgaacattccatatattgatatcatgcgcatccatgatacacgttgatgcgtttcgaatattttctttggtggcataaccaagttcagtggggaaagagttgatatcatgcaaggagaaataacctactttcggaaactcagcgaaggattttccaaattcatcgtacttgttatcatcttcagatgctccgtgttctgcatctgtggaaaattcgtctggtctaaatcctgcacgtttccaacaaatgtcttgagtaccatcaccatgatgtaaatcaaaatcaagaattacagcatgagtgacatcgtatttttcaaaagcgtattcgattgcgatatgtgcgttgtttaatagacagaatccagagggagtggatgcatgagaatgatgtcctggtggcctaatggcgataaatgctctatttgctgtctgctcaacactcacaccttggaaaatcgaatccacaccaatttctaaagctccgatagaaccctccaacgctgctatggtatgtttggaaagataaatatcaccgacattccaatcagggggtacctctacttcttcgttatcaatttttttctcagactctttacagagcttcaaaagttctcgcggccaatctttcccatgaactttcaacacatgaggtgctaataacgaagtcttgtggtgatttgatgtcttcacagaaaacaaagccggatacatcgtaatggctgcagataccccaatacaacatgctaataatctctctggtctttctacaatagtttttttgtatgacttggatacccaataacgggggaactgatgtgataaagaatatggtgataaaactattacggctttagatgattcagggatcctcgaggcagaagatgtcacggaagaaacattagggttgctagccacaaatttttcgaactgaaccttaaaattatgtaacggatcttgagacattgcttccaggtctgtggttggcttagcaatcagattagtttcagtcctcgtaaataaagaacttttcgaagttctcaagtaatgcgaaataaagaattcaaaaacctataaccctcaatacaacacgcaactcaatggcagacggactcttaaagtagttggaagtttgaatctgagagcaactaatacttctttacctaataaagataaacccaaagatcactcactgcagatatgcgtgctaaatatgcaattataaatatatcggcattcttcagggttgtggtgtatttgtttgttgtttgctttgatttttaaaggtttttcgctgaaaagtatagcagttgaggattcgatctcaaaatagtaaacaaagaaaactgatccaatgagaattgaatgatccgtcgcaactgactagcgttagtgttcagtaaggggccagaaactttgtttacactagtgcattgtattcagcctgattgaggctgtatatgatacagtacattctttgctcattttatcttatctgttatttatcggtgagtaactaaaagggtacgaaattgaaatctctcggagtcctgtaagtttaccacagacaaaaatatgatctcgattgaaattcgaacccaaaacttattcttgtatttcttgaggtgttgtcattacatatcttattgtgttttcgcgtttggcataaactctaaacagtttgctgcacatatatatgtatgttacaaagtctcggcttttactgttcgaactttgggtggcagcgcaagtaacataaaacagggtctaagccatctttaagacatttgaacggcaaacgaaaggcaacggtacattgtcaacaaatttattagtaccttgaagcatgctttcttcatgatttcgcctatttccctttttaccttctatgcatatgtatttcgaaagactgtgttcacaaggattttatacaacaaagaagatatctttcatttgaaagaagaatgatgagactttgccctgaagaaagcaagcataataagctgaaatcaatctgcagctgcagttcagcaatgtatccaggtcgtgccaaaccaacatataacaaccagcaagctcaacaggctcaaagccaagttggatatcaaactggctactcgaatgctcagcctcaacagcagtattatacggctcctcaacaacaaaatgtcagtggttcgtcaatgtccttccaacaccagttctaccctcctcctaaccaaagcccgccacaatataacactggtcagtacgccagacctgctgccccacctccaggccaacagaattacagaaatgatattcaacagaatcatgcttcaggtactgtgaatggtccttctgggtaccaacagccacaggctatgtataaacctccttctcaggttcagcacactgggccaaacaaccaagttgcgtaccaatactcccagtgtactggtagacgcaaagctctattaattggtattaattattttggttctgcgaacgaattgcgtggttgtatcaatgactcccataacatgttcaatttcttgactcaaaggtatggttacaaagccgaggatatagttatgctaaatgatgatactaccgaccctgtgagagttcctacgaaagccaatatgctgagggctatgcaatggttagttaaggacgcaagacctaatgatgcattgtttttccattattctggccatggtggacaaacggaagatcttgacggtgatgaagaggatggaatggatgacgttatataccctgttgacttccaaatggctggtcatattgttgatgatgatatgcatgcgatcatggtttctcctttgcagcccggtgtgagattaactgcattatttgattcgtgccattctggtacagtattagatttgccatacacttactcgacaaaaggtgtgataaaagaacctaacatgtggaaggacgttggttctagtggtttacaggctgctatggcatacgctactggtaatacaaccagtttggtcagttctttaggaaatgtattcaccaccatcaccaagtccaataataacgtcgacagagaaagagttaagcaaataaaattctcgccagctgatgtcatcatgtttagtggttcaaaagataatcaaacgtcggctgatgctactgaaaatggtcaaaacactggtgcaatgtcctgggctttcttaacagtactatcaaaacaacctcaacagtcctacttaagcttattgcaaaatatgagagccgagttaagtagcaaatacactcaaaagccccaattatcttgttcgcatgaaatcgataccaatcttcagttcctactatgatattggagtcttaatcttattgcaatcaagtatacgatggtattataacgtgctttctttaaaagattatataagaatatccaaacataaacctacatataatcaattcagtttctgtttaagatgctaatataatttagaagtcatgggggtcattttgttatgaggacactccagatgaaacattttaatcttttccagccgataagttttaatatgtacttgaaatacaagaatgaaaaaggcaagcagtggacaacagaaaaaaataagtctcgtatctacatcagttaagcttcagttgggacagcggcatcagcggcagcagcgtcctccttttccttttgttccttcaattttttggcttcaatttcttccttaactttctgttctttagcttcgtactctaagttaagtttcttgagctgttcttcagcttctgcaatgttcttttcagtagcttctggttgcttggcagtcaagtcctcatgcttagccttcaactgttcaacagtggctggaacatcgcccttggataatggtactctgatatctaattcggccaacaaggcgatcatggatggctctagagagaactttgtagattgcgccttcttcttgtgtttctttgatttggaagcggttgaagcggagaagaatccttctctttccttaacgattggcactaacccttcagaatcaacagtcttagttggggtggcagtttgttgagatgtgctaccgaaatcgatacccaagacgttcttcactggcttaacgtaagttggatccaaaacagtcaacatattctcaatggattccaattcgaaggtgaaagcaggctgtttggcatggtttagtctttcttgtagcttgcccactttttcttccttatcttctaagatcttggatagtttttcgtcttcttcacgtttcaaacgctgctcatccaacttcttcttgaatgacttgaattcgttgtcgaaatcacctctgatcttcctaatttgagtgtagatttcgtcacgcttgttgtacaaggcagaacgcttagtgattaaagtctttctcttgtcgtaaacaacttggttcttagagtttaagttattgatctgaccttggatagtttcgaactttgcggcaacctccttcgggttagaagcgttcaattccttcttcaaagcatcaatttgttctttctcttcttcgatagattttctaattggttccacaacttggaaatctttggacaatttgtgcaaactttgcatttccttgactcttaacctttcctccaccaaggataagtcaccagaagcgatttcatcgtcaatttcagccaatctttgcttgatttgaccaacattttggaacttcttgttcttaccgaccaaatcgttgatctcaccagatttacgtttgatttgagcatccaagaacttaatctggtcatggatttgttgtctcttagccttcaagtccgattgagttttgatcacttccttcaattcaccttgcagcttttcctttgaattcttagcatctttggagaaatcggtattatcaatttgttgcttgatcaatgataattcttgatcaatcttcttcaactgaacattcaatggctctagcttcttgtctctgacagtaacatcaggtttctgaatatgttgttttggtctagcagtggacatccttgtaatatattattattctatggttattcacttggtcacctggaactagcaactgaaacaagtaacacaaaacagactggtggaaaaggttacagttaaaaagaaaactttaagtatagaaatggtaacttaataacactaattgaactgaaaaaatactgtctcaattaacgtatctcaaacacaacctttgtagatcaagaatttgattctgttcaagaatctgaaatttttaacacgtttgaataatttttcaacgttcaattaaaaaaatatcgaatctttcccaaaagctttttttttctggaagacaccacgaatcttcttacagatcaacagtgctctcagacggatcggaccttttgtgtgtattattccctccggaacatgacaaagcttgagcttcaatctgggtagacaatatattctggtcatttacaaattttcgtttactacacagcttctcatccttctaattaagtttcctactcttccattgtaatacgtaggtgatcctcagcgacaatttccggttactgtcgtttgagatttttctatattaaataaaactgggacatttctctcacagtgtgttagttcattgcaaagcttcaacaaatggaataagaaatggacaacagcagcagcctactgtgtcactattggtagcatctcgaatcgcgtgtctttcgtataaaagtttccattatttggccgataccgaaatgcaaacaaaaaaaaaattagatttaacgaacaatttaaaagaagaaaagttgagctcattctgctttaaagaatcttcgaaaaccatcttgcggaataaagctaagcgtatgcatcctgtaggacgtgcaggaatttcaaactgaaccttcacttagcggaccaacagaagagatgtcaactcaaacttctacctatgcggaccttgtgcattcattagaacaagatgacatcttagaaaagtttcctgaggtcatcccattgaacaacagaccaaatacacattctactgaatcctctggcgaaacggataatttgctagatggatatgatgaggaacaaatcagattgatgaatgaaaattgtatagttttggattggaacgatactgcgattggtgctggtacaaaaaaactatgtcatttgatggagaacatcaaccaaggtctattacatcgcgcattttctgtgttcctttttgacagcgatggtaaattactattacaacaacgtgccactgaaaagattacttttgcagatctttggaccaacacatgctgttcacaccctttgtgcgtcgatgacgaacttggactgaacggctctttggaaagtaaaatagagggtgccagaactgcagcagttagaaaattggaacatgaactaggtatcccaccacaagaggttgaatctaaaggagaattccactttttgaaccgtattcattacatggctccaagcgatggtgcttggggagaacacgaaattgattatatattcatctatcaattgagaaaaggagagactctgaccgtcgagccaagcactaatgaagtaagagatattgcttgggtatctcaagaagaattaaagcaaatgttcgcagatggtaacctaaaattcactccatggttcaaattaatttgtgacaattatctattccaatggtggaatcaattaaatgatttgaacaaagtcgaaaatgataccaaaattcacagaatgatgtaaaaacaaaacaaaagttgaattccggaaacattgtacattgactcatctattgaatgagatattccctattaaacgaaaagttcacctggcagatattccctttccgcttctctacacctaatgattgcaattaattttggtttattctatttacatgaataatatttcagaaaaatgtccagtaatccagtatatatctatatgtatagtgcaaaactctttctttcaatttaagaaaccattaattagtagagcagtagcaacactaacgttcaatgagtcaatagtgtttcgtccctcggttgggtctctcccaaaaggaatctctacagtgaaatcacttctgttcagtaggtttgttctaacaccgtttccttcattaccaacaaccaaaactactggtagctcgttcagcatgccacttaattcattcattgttaagtgatttcctttctgtgaaatgctcatatgtgaagtaacaaacatccatcctccatcctgtttggatttttcaaagaactgcaagggtttagcggtggtaaatataggtaatagttccattgtaccactactgacttttgagaccactggagacaatggcgcacaattcttgtgtgagagaaccataaaatccgctcctaagaaatatgcacttctgatgatggcaccgacgttatgagggtcgacaacttcatctaagtatattcccagtgggtttttcttattatcattagtcatgaacttctctctagtgtttactgcttgatcataatcaatttcgctcttgtcgaatgtacatgcttcatggtttaccaacccaagatgagataattcaggaggctggagtggtttacattcgagaaccacattattatgcacagcataattagtgtatagattaagcctatgtttatctacctcttcagtctgaatattatttttcgaacacaacgattgaatctgtgtattcaatggtccgtaatgatgcaactttacgaaatattctctcttcttcgcagttaaggcactaattacactgttggtaccaaaaacgtaatcaaccaacgggttaggctttaaaccttgtaaagggtgcattttagtatactctgacctatgacttctaaactgttcccttttggacgattcttcttgtttgatccgatcgtaatactttttcttcttatcgaatgggtcacttcctccgttattcagccttgcatttttttctcttgcatgaacatgtgcgtaatttttcctgaaccatttatctttatccattccatctttctcccaagccttagtcctcttatgcactggaaagttccgatcgaacgttacttttctgtccttaatatacgattcgttaggcactttgaccgcagaacgaatcttgttcgaataacttcttgtgatgtttctgagcatgctatactaccaatggttttactttatttgagtctgctatgctcttgttaacagataatgtatcttttattccatgcctctcagctcatctcatctcggcaattttttgttatcaaatagcttaatctgaaaaatttcagaaagtcaagtttcaagcttttctttatttgtaaaatattccagaagatgattcatttctttatcgtagtagattgacagaagcgtaaaggtatattggaagaagaaagaaagtaactggcctcaacattagtttgtgtacttataagaagcctaaaagttgctaccatcgttcatatttggcacattttgtaagaattcctcgagaaagaactgtcaaccaaaaatgacttatccggaaagaaaagcttttgtttctagaataacgaatgaaaccaagattcaaattgccatttcattgaatggtggaccaatttctattgagaactctattttacaaagggaggaatccgatgctgctaagcaggtaactggatcccaaatcattgatattcagacaggcgttgggtttttagatcacatgattcatgctcttgcgaagcattcaggctggtctttgattgttgaatgtattggagatttgcatatcgatgaccatcataccaccgaggattgtggtattgctcttggccaagcctttaaggaagctttgggtcatgttcgtggtgtgaaaagatttggttcaggatatgcaccattagacgaagctttatcacgtgctgttgtggatctatccaatagaccatacgcagtaatagagttggggttgaagagggaaaagatcggtgacctttcatgcgagatgatacctcatttcttggagtcctttgctgaagccgcgagaataactttgcacgttgattgtttgagaggctttaacgaccatcacagaagtgaatctgcattcaaagcacttgccattgcaatcaaagaggctatttcaagcaacggaaccaacgacgttccttctactaagggtgttctaatgtaaaattccttttcaagaaaggagtggactctcattgcatatgcgcgacattcattttaagtttacatcaaatatatattcatccattttgttccatttaagttacgagcacggcccttaaccgcttgacgcacagctccgtcttccgcgtaacatgactgtatttattacgttttatttacaagtgacttctagctatggttgtgtaatacctaccatatatcaacttacatggttgtctttaataagtttaggaactcttcactttgagatctagattcttcggcggtgacagatcttacagtttttcttgaagagtttctggaatcggatctggtataatgtgatctgctttgacctaagccgatcttctgagcaaaactgaagtcatttcttggttctactaaagatgcagacaatgttacattacccccttctacctttggatcttcaatggcaaatggtaaaacttcttgtctgacaaaatcacccatgttgtattgtagagcacgaggattacggcccacagatttagcttcagcgatgaaaccaccaacagcgactgcgcgatcaggtccctggacagataaaactctgcctggcacaacgtgcttttgttttacaccatttggagattgtctaagtctacctttcaagttgtaagttagaccaccggtgcccacaatgtgccactccgagttagctgctgtattaatattcaactttcccatcttttcatgtaagaattcagtagctaaagccttcaaaggtctggtgttttcatttctaacaccagcaatggaatccgggtgtttctctaacagccacttcttgaattctgatctgtgttggtcaatttctttcaactttcttgtcttttcagaaggcgcagtgttatgagcaatgttcacagcattgctgaatggcgcgtattttccggccctcttggttttcccattgaatagaggattggattcttcttcaacgtaacgaggggctaaccccatttcttggaatctgattctgttccactggtattgacccattggttcaaaagtcgttagtctttgttgggtgtccaaatcgttgtaaaccaaatatctggtcttgattttcgatggaatgcttgccttcaaaccccattcctgacgatataaggaggatggcttggtctcaatcacttgatgagttggatgagaagagttacctggacgaaacaatggcttgtccgtctttgccacttgtgctatcctggaattttttaacaaattagatatatgggacatagctttctatttcgaattgtgaattcagtaagtatatctgtcttcaagctaaggactaacagcccagtttaaacccaaaaagtgaattatctattcaacgaattgctgatagttttggaaccttgtcacaatagtcgacgataggaactaatttagctcttcagtcaaaatcagtagctgagctgtgtttaagatttatcgaattgaatgctattcaatgatatcgaaatttttttatcattagaaacgtaacattttacccggacttgcgacagaccattgatgaaagtgtcacatttagtactcattttaaaggaagaatggtttcttaagtgatgctaatatttaaaacgagatcagcaccagtataacataagtcttctatgaggggtttcccataatcagaaatcggtgttgagtttaaatttttttttcaattgcattatttattatattgtttactacagaaaactattcattttttcgtaataatttcatatcaacagttccttggtttagtcgatactgtatgagaacctcagtttcgtagaaatgtttgtactacttgacaaggttatcagatagtttcgagcacatgtctccgctatccagaagctcaacaaaaactgatttttttccagtaacctcatcaacacagtagatgtcacgatcggtctgaatgtcaatctcaggtgctctaataaaaggtttccagttccctgtgtaagctttatgaccaaggtaaagtacgatggtaattggaacagccatataattttgaaggaatgagacgacattcagcctaccgttggattctaaaggaaacaatgatacccaaaattgtactatcaaaataatggcacaaataaacaacgagatgtaactgccatatacaccacatggtgattgatatcctaattggtctaaagcttgatcttgatctttcattgcctttctgaatctcaaatgagacacacaggtcatactccaagtaaagatagtggaaagaccgctgattgacaataaccaaacgaagactgtttcctggtccttatattcggctatgaatgaaaataaaccagtaaatgctgaaacgcaaagacatctaaacggcttaccactttcatccaatttacaaaaatatttcatcgcaaatccttgttcagctaaggaatgtaatgttcttgagctactatacatcgcattgtttgcgacagaaataatagacaatagaataattgcattaacaatatgaggtattatcctaacaccattggttgttaatgcgaccacatatggagatgcatgggtcagttctgatccagaccccatcaaatatggggaattaaagggcactaataatccaataatcatcaaagaaacgcaaaaaatgatggcaattcgtacaacaacttgtattgacgcccttttaatacttcttggcatgtcttctgtattctgttcagcacaactcaaggcgacaaactcggtaccaccggtactaaagcaggcagttatcaacgttgcagcaattgacttgaaaagcccctcatcgtttctaaagaaccctggactatggaaatatttgaaacccaaatatccgctagtgccgacaacaccagtgttaacgaaaatacctaaaattatgaacccaaggatcataagcactttcaaacagttgaaaatgcaatcagcgtccgcataacaccttgcaccaaagaaattcaccccgcataccaaggaataacataatgcaacaacgatagaaggattgatattttcgttccaaaagttgatagtcatagaagcgacacatatttctaatggcaaaacgacagtccaatttagaaaaaataaccaagaaatggtaaagcccacagacgggtctatgaaacgctttccataagatgtaaacccaccaggcatacttggaaaagcaacaacaagctcaccaacagtttgcatgcaacatgtcaacataataccaataattaagtaaccaactaaagtaccaccaacccccgcaatagcaattgatctaccgttccccactaataaaccggtcccaatacctgttgcagtagacatcatgaaaacatgaaacggtttaattgactgttttaactcatttttgggaagagtaacatcagctgtagtatcgatactgttcgttcttgtgggatctgagaggttggaaaaagttgcaacttcttttaaacattcttcagtcattttttaataattgactgttcagcgaattagtgctgtgattgatgaatgtctattactcaggatgaagtggagagtagcagggaacaggacgcatcctcgaaagctagtttttttatataagaagtgataaatctgacacgcaccccgctcctggcagatttaatcatccatatccgttatgaaactccttctaacacaatttctgaattttttagcattacagagctgatctaataccataaactcaattgaaacctgttgaaatgcaccatttcctgaatactctttgacatatcacaacacttttttttctcttaaagcttgaaaaaaaactgtcgcacgtcagaaacgctgtttgcctgatatgaaagtttaatacgtaaatgatacaaagtctacaatgtgttgttcaactctcagagatacccgctcagagaaaaatacaatagccaactgatccttcttcacaatctaattaaaaatacgttaacctggaataacctgcaatgtaagccgatcttctaatcgttaaacatgactaactcccaggcacgttacatacagagaactaaacaaaaatgcatctagaataatgagggaaaggaaaaatttttcgcacattaaaacgcagagcccaaaaagcgtgaaaatttgtgaaaaagaaatgagtattttaactgggaaagaaaagaaggaatataatacagaaaaaaaaattgaattgaaggaagagatacgttttagtagttacttttgttcagttccatcctttgtactgtttacagacaggttaaattattttgtattctatatataaaagttttcatatactttcagttcttacttacagttctccagacttacttctcattaaagatatacatcttaagaaatactttcaatcttattagaagatagatagacggagaatacgaatcaagaagaagataaaagtaaagagacaataaatttattaatcatgtctgatattgcggaaaacatgtctaatttgtctgttcaggacaatgattctggtgcaacttcaggtgacagcagacgttcttatgttcctcctcatgtgagaggccaacaaagaagtggtagcggtaactatcgtggtcgttctgataacttcggtggtaacgagagatccttctttggtaacgaaagaagaggcggtggatacagcagaggcggtagaggttccgtcaactggggtggttccaactggggtggcagaaacgacagtagaggttctggcggttacggtggtggtaactcatctggtagatggatcgacggtaagcacgtcccagctgccaagaacgctaacttggaattagagttgttcggtgttgctgaggacaagagtttccaatcctctggtatcaacttcgataactacgacgatattccagtcgaagcctctggtaatgatgttccagaaccaatcagtgaattccactctcctccattggatcctttgttattggacaatattaagttggccagattcaccaagccaactccagttcaaaaatactctgttccaatcgtcgctgctggtagagatttaatggcttgtgctcaaactggttccggtaagactggtggtttcttgttcccagttctgtctgaatcattctccagtggtccagcctcaaccccagaagctgccggtaactcttacatcaagaaggtttacccaaccgccgtgatcttggccccaaccagagaattggctactcaaatttacgatgaagctaaaaagttcacttacagatcgtgggttaaacctatggtcgtttacggtggtgccagtatcgacaaccaaattaaacaaatgagatacggttgcaacttgttggttgccactccaggtcgtttgactgatttattggaacgtcgttacatctctcttgccaacgttaagtacttggttttggatgaagctgatagaatgttggatatgggtttcgaacctcaaatcaggagaattgtggaaggttctgacatgccatctgttgataacagacaaacattaatgttttccgccactttcccaagtgaaatccaacatttggcttccgatttcttgaaggactacgttttcttgtccgttggtagagttggttctacatccgaaaatattacccaaaagattctttacgttgaagacttcgacaagaacgatactttgttggacttgttggccgctagtaatgaaggtttgaccttgattttcgttgaaactaagagagccgcagattccttgactgacttcttgatcatggaaggtttcaaggctactgctatccatggtgaccgtacacaaggtgaacgtgaacgtgcgttgtctgctttcaagaccggtagagctactatcttggttgctaccgctgtcgctgctagaggtttggatattccaaacgttactcatgttatcaactttgacttgccaaatgatatcgatgattacgtccacagaattggtagaactggtcgtgccggtaacaccggtgttgctactaccttctttaaccgtggtaacaagaatgtcgctaaggaattggttagtttgttgagtgaagctaatcaagaggttccatccttcttgaccaccatcatgagagaagcttctagcggcagaggcggtgccagaggtggccgtggtggttacaaccgtggcaacagcaccagagatttccgtcgcggtggcgccccctctggtggcttcagcagcggtggcggttccagcggcggctggggtaacggtggcggctccagcggtggctggggtaactcttccggtaactggggtaactcttctaactcctcaaactctaactctggttggtggtaaatcatcacattcaaagcttattttcctatcatctttttgaaaatatatttttgatcgctgagtacgcactcattttttttaattaatcctcagcatctgctttttcctttattgctttgaattatttggtgttttctcttttattgttttcacaaccgtattatgcaattgtacactagtattacgttctggttttcagagatttgtttctcttagaaggtcgaaacctgaaactcatttttttccaatattttattatattcaccccgattgacatttgcttgtgtattctgatggaataatgttgatcattaccattccgagaatattcatgatagaaaatggtttttatcctatttcatccataactgaaacttatttcacatcaaactcatttttgttactattatttatcatggatttgaattcattcaacttttttttattgttttaacgcataactatagagtgatacgtttgtgtttcgttgtcgcttgtaatcacttggtattcattaatattctttcttaccaaaactatactttcccgttttcgacaacgacacacaaggctctatgaatggattatattgtattttgtgtcaatttttccgtttttcctttttaaattgtatatgcaagcaatggtagaattgtataatagatcatgtttatagataaaacactgaataaggctttactaattataacttttttgtttcttaaattacttaaaatgaaatactattcaaatagatgagatacttgatattaaaatatatcccgttaatgttcacacgttggtatcatgcttgtcaacatagttcaatggcagtaaccataaatgtgggatgcaataagctacttatcaaaatttcttctgtggaagtctagcacctgtgaattgccttcagttgacacaaagaacatcttcttcttctcgttttgccagagtagtacaccaatatcctttgcataatctgctacagtttggtattcttggtaggactcgaaatctgtgtatagatatccatcgtaacttatgattctatccaactcaagttgccacaatcgtatttggtcaacaacggttggaggtaaaacctgaagggtctccttcacggtggggtctaactctaattttttactcaaattctcttctgccaatcgcctcattctcgggtgagcatgagtttcaaggtatgctataatttgttctgcagtaataccattcaataaagcatttcttacagattctctcgtaagctgtccagtcaccatattcgcaaatcttgattttagatggacaaatagcgatagaatagcaatttgcaatggggagttagaatatgaatatagtttgaagttagtctctataatcaaggcaccgtcttgagttcgctctgtagtttcatcttgtccactgtctccttctacagctgttgtttcattagctttatttaacacgctgtctagagcgactgaggcacttctgaatgcttttgtgtcggacgtcaacaacgtggctaatctggtaggataaaactttgcataatccgattgattttgatagattaatccgtaatctctcatatcctgtaacattgttctctgcgtattacttagttgatcgcacttatacgccttccctagctgtaatgcacctagcatgaaaatgaaatttagaacatccacgggatccatctgtaaactttctgccatcttcaaatattgaagaagaagagtccacatctgtgcattgacatcttgcaagagaaattggaaaccttggttagtaattttgagttcgccatattctgcctcttccattagaccactatgctgcaataagtctagaacctttccaccaggagtgtttgtattcggtgttcccaccatgtaatgcaagattgtttcccacttttctgcactatactggtccaaagtagctgtagatacgggattggtatcatcatccgcaacatcaccaaaagagttattgatttcaccaccagttaatacatttttgaaagatttcttgaaaattggattcaaacgaatcaatagaggttgtttactctcaccttctattataagattcaaggatttcatcgatttaatagagtattgtaactggtatttcgcatctggcttgacccatttatctaaatctctaagcgagacatcgtggtcctgaaacagcatcgacataatgaagaattttgccatgggagaaagcaatctataaattgccaaacatgtcgctggagactcatataatcttgattggacttgctctggaagaccttctaggtagtcattaacggtggtcttgaaaagattcagactcatagtattgaaaatatgcagctcaaggcctcttgaaatagcaagagattagaaccaagtgaggagatcaacaatttggtcacgtcaatcgataatgttatttcagcctaatacgatttgctgcattcgaacgatgcaatgcatccatgatatccgatttggaaaagctcatctgaatcaatagtacttaaggttgataccatgtcaaatccagacattcgcatattgaaagtaaaatatatgtcacgtgtatatatatcatgtaacacgaagaaatgtatcttgcacgtgactgaaaatttgttgatgacagaagaaatttcttttcactctgtcagatcaattttggaaaatgaaaaagatcaaatcaagctcatctcgaatttgaaataatcgaaatacgccaatgattaatgtagatgagctctgtcaatattgatggaaacaaagagaagtgcatttattggcagttagtgactgtactgatttgctgacctcaacaaagatttgattaagtgaaatttactggttggctccttcttttttcactttcagtagagtagctttgtttggtctttttgcctcttttctagatattttgtttgattaactgtttggaacactaattaagtttggaaagggtagctttcaaatatcctgattgaatattctctaaaatgaaccacactgactcccataatcctgatggctatgaaaaagatgaagcgttcgatgctcttttgaaacccgtcttcaaaggtaaaaagctgactgacgagatcaacactgccgaagataaatggaatcttttgcctgcctttttaaaggtgaaagggttagtaaagcagcatttggactcttttaattactttgtggatgttgatttgaagaagatcatcaaagctaatgaggttatattatctgatgtcgatccagagttttacttgaagtacattgacattagagtaggatacaaacataacggcaacaaagctattatgaccccaccacatgaatgtagattacgagacatgacatacagtactcctatctttgttgatattgaatacaccagaggaagatcaattgtgttgcatagagatgtggagatcggtagaatgcccataatgttgagatcaaacaaatgtatattagatggtgcagcagaaaatgatatggccaaattaaatgaatgtcccttagatccaggtggatatttcattgttaatggtactgaaaaagtcatcttagttcaagaacaattatctaagaatcgtatcattgtggaagcagatgagaagaaaaacatcgtacaagcttctgttacatcttccacccacgaaagaaaatctaagacttacgtagtcaccaagaatgataaaatatacttaaaacataactctatcgcagaagaggttccaattgtagttgttttgaaggcttgtggtgttgtatctgatttagaaatcatgcagttagtttgtggtaatgatagcagttatcaagatatcttcgcggtgaatctcgaagaagctgccgaactaaaaatatacacgcaacaacaagccttagaattcattggtactaaagttaaaactgtcagaagacagaaactttccatcttgcaagaaggtatcgaggccatcgctacgacagtcattgctcatctgacagtggaagctttagactttagagaaaaagcattatacattgcaatgatgactcgtagagtcgtaatggctatagataacccaaagatggttgatgacagagattatgttggtaacaagcgtttagaattggctggtcaattgatgtcattgttatttgaagatttattcaaaaagttcaataatgatttcaaggcaaacatcgataaagtcttaaagaaaccaaatcgtgctgaaatgtatgatgccttactaaccattaacgtacattccaacaacattactacaggtatgaatcgtgcaatttcaactggtaactggtctttgaaacgtttcaagatggaaagagcaggtgttacacatgtcttatccagactttcttatatttcagcattaggtatgatgacaagaatatcctctcaatttgagaaatctagaaaagtttcaggtcctagagccctacaaccttctcaatttggtatgttatgtacctcagatactccagaaggtgaggcctgtggtttggttaaaaatttggcattaatgacccatatcaccaccgatgatgaagaagagcctataaagaggatttgttacttgttgggtgtggaagacataagtttaattgacagtgcttcaattcatttaaattatggtgtctacttaaacggtacaatcatagggacaactagatttcctacaaagtttgtgtctcaattcagatgtttaagaagaactggtagagcgtcagagttcatctctatatataccaatacacatcaaaaagcagttcatattgctactgatggaggaagaatctgtaggccgttgataattgtttcgaacgggcagtcttctgttactgcagaccatttaagatctcttctggctggaaaattacaattcgatgatttcttaaaactgggtttagtcgagtatctcgacgttaatgaagaaaacgactcgttcattgcattatatgaaaaagatctatctgagaatattacgcatctagaaattgaatcatttactgtcttaggtgcagttgctggtttgattccatatcctcaccataatcagtctccacgtaacacttatcaatgtgcgatgggtaagcaggctattggtgcaattgcatacaatcaattcaaaagaattgacaccttattgtatctaatgatataccctcaacagcctatggtgaaaaccaaaacgattgaattgatcgattacgataaacttccggcaggtcaaaatgctacggtggcagttatgtcctactccggttatgatatcgaggatgcgttagttttaaataaagcgtccattgacagaggttttggacgttgtgaaactcgtcgtaagaacaccaccgtgttgaagagatatccaaatcatactcaggatattattggtggtatgagagttgatgaaaatggtgagcctatatggcaacaccaagcattaggccctgatgggctaggtgaagttggaatgaaggttgaaagtggacaaatttatgtcaataaatctgttccaactaatgcgtcggatagcattctaactcaaacacaagctcagtacaaggagactccagtggtatatagagctccagaaccttctcatattgatcaagttatgatgtcagtttctgataatgaccaggctttgatcaaagttctattgagacaaaacagaagacctgaattgggtgataaattctcatcgagacatggtcaaaagggtgtctgtggtatcatcgtaaaacaagaagatcttcctttcaacgatcaaggtgtagtaccagatattatcatgaacccacatggtttcccatctcgtatgaccgttggaaaaatgattgagttgatatcaggtaaagctggtgtcttgaatggtacccttgaatacggtacctgtttcggtggatctaagttagaagacatgtcaaagattttagtcgataatggtttcaactattccggtaaggacatgctttattctggtattactggtgaatgtttacaagcttacattttctttggtccaatctactatcaaaagttgaagcatatggttcttgacaaaatgcacgcaagagccagaggtccaagggcagtgttaacgcgtcaaccaacagaaggtagatctagagatggtggtctaagattgggtgaaatggaacgtgactgtgttatcgcatacggtgcttcacaactattgttggaaagattaatgttaagttctgatgcctttgaagtcgatgtttgtgaaaaatgtggtttgatgggttatagtggatggtgtacaagctgtaaaaccgctgaacatgttgtcaaaatgactattccttatgcagccaaacttttattccaggaattgcttgcgatgaacattgcaccaagattgaaattaggcgatgtctttgaagcttgactgtaagcattttctgacgattctagtagtaacattatttattcagtattacttataaagcatcattttcacttgaattttcattattgattagtatataccatatcatagtcaacttttagtttagccgctagctcctgcaaagtcatttcatcattatcttctttccttagttcattctcaaatttctggagttcgttctgtttcatttcttctgcttctctcactttctcatccatccgttccctgatttcttccttttcttcaattggcaaatgaaagaagtccggagattccaagatctcttccatttgttgttgaatgccgtcatcgtattgatactcaacttggcgctttcttgcctctatttctttccgcttatactcttgataaccgcccattcgatcaattttaaccaatatggtattcaacatgtaagacatcccacattgacatatagacctccatttatttattaattcgatagtcttgagttcgttgtcgtaagtttgcattattttcactgcccttttcaaagcaaactctttcttcgtaagatctcgtatttgtcgatcaagatcgttctctaacctccggatctcctttaaaagtaacacactacccgtagatctttcttcagggtttctgcaagataacttgggcaagatatcactaaatgaatcattctcttgaactaaggttgtttcactatcaccttcaaaattcatgacattcgacataacgcctgtaatgagtactggtataagaattattccacttggtcaagttatgcctaccgcagattgtactcccgagctttgtattctgaatgtaatgttgagtatacatgtttaaaataatttacataatgtaatttctattttcatgaaatttaccgccgatgtctttgacaaggaggcaatccaatataagatggtcgaagacataggattaccaatgaatttaaaattgaagaaagtttgaacttatcatacaatcatttgattattcatctgcttcagattcagcatcatccattactatgtcttgggctccgtcagaaatattttcttcttcttcatcatcgtcagattccaaggattctcttaagagtctggccttttcttccttaacctcattttggatagcaacccaggaaccaagaggagtatctttccacgatatttcatttaagaatttttctacttctgttctgttgtttggtccgaagtctacatctgatctcttctttgtaatgaattgagcgttttggttgattttatctaccacgttttgcaacatcttgttaaactttacattctcagaattcttgatataacgacgtaatgagataacggcaagcgttgttaattctgggaatgaaacgcttctggagtatagaacaaagtactcacctagcaaatctacaaattgctcagctagcccgtcttggtatatttttgtccccaagtatgcttgtgtacacttgatgttatgatcaaagtcaaatgcaggtaacgttgactttctaggtttctttgtgaatgcagtagaggagagaatctcagataataatgggtaaactggaatgaagataccagtgttttgagataatctgatcaaggatctgatcaaataaaatctcaatgggaaaaattgtgctgttggaatcaatctaatgacaccaatggtaacttggactagtgggtaaatcaattgtctaagaggggattcgtggccgttttccttttctgggttacattggatggatataacacgagaccagaagtccaaagagtgacagaactgccagttatatacaatcttgtaagcacttgatgggtccacctttgaggacctcttagttgtggcattgatactgtttctcaagtgaatggctagttgtctgatatattcgaaacccgattgataacttataacgtcatcaataccgaaaagttcagcagcagagttcttttggaaattgattagaggcatgtttctgatgttagttttacgacaacttttaatgaaagtagaatacgtggacttcaatacaacttctaataaagctttcttatattcacgagaggcattgttcaaaaacgcgaatgtggcaatttgagtttcaacgtctccagtagtggaccaaacttcgacgacttgagaaattaattcttttagtaatcttctaaatgaaataaagtatggtaatagctcataggtagaatgcaaaatcattgaagcgacgtctgtgtttgtgatgtcacttaggagaacgataagagatggaacgtgcgatttcaaaacagaggacaattttgtaacatttttatttgatgggagagttctggtttcattcttactgaccctataaggtgtcaatttttggacggcttttggcatatccacaagggcaacgaacattaactcgtggaaggctttttcatcaagaactgtgaacttgtaatcgtctacattttcctcgttgttcatgttcacagcagctttaaaagctgaaaccacacttctgatagttttgaaagatgggctattttttaaatccttcttccatttatttacgagctttatgtcgacggcaattttgctatctttttcctccttcttggactttgataaatcaggttctttcagttcttcttcttcacccacttgcccttcttcgtcatctgatatttcatctagaggattggtagatttgaaagacaaaagatctggttcgttctctgccaaatatttgtagaaatcaggatccttctttgccaaatcttccatatccattttaacatcttcatcttcttcggcagaagactctgaatcattatctttcacctttgatgctttttcggtttctttagccattttctttgacatttttggaatatcgaacccattgtcgaagaactcttcaaccttcatgtcgttgaagacttcttccttagcggacttcttcaacttttgatcttctttggtcaacgcagctgcattcttttcttcttctgtcttattacccctacgaccggcggttctcttagaatgatcttttaacttctttctatggtccaacgtatgcttcaagtgtttcgtctgaaactttttagtagcttttgaaactttacccattgtgtaattcttgatccctttatcaataggtaacaggtcccaagattatgcctttgatcaacaatatgatttcaagaagattatctagagcgactactggttaagttgttagagctgcgttaaagtttctctatatctcttcttggggcatctcatctcatctcatctcatctcatctcatcggattgaattttggtttggatatttggaaaacttttcatggcgtttctttttgtatccgggtaatggcatcgccttgacatcgatgaatagtgcaagtaatatggtaattgacatgcttggaaaggtatcgacaaaagatgcaacaaactgcaaacagaatgtcgagagatgcaacagttttgagccgttattgataagagtactgaggtatatgcatcagaaaatagtagtagtattaccttttatgaaatcacggctccaagcttttaagcagtttactcggtttgtatcatgcaaaagctgtggtgttgagttgcaatccaagaatccttctgtgacaggctactataagcctcctcgcgctgtcaggaaagatgctggcaccattgaagatttgaagtatttaatgttcacacaagaacttcagctaaaaaaacatgaaatcgggctacttgatccagacaccgatccagattataaagaacctattcccaaaagattggtttgtaaaagatgtgtcgatgctataagtcataacaggtacaactcatctgattttccaattcattctttcaacgatataaagggcgctttgccgcatgctgcaaacgtataccacgttgtgtctttgtctgactttcccttgtcattagacaaaactatcctggcagaaaagaataatagaaactatttactactttcaaaggctgatcagatcacatacaagtcatcaatgctaccacataaagggagtgctttttttgcggaattttgtagacgtcatataggcgtacatgttaagaaagtagtattgttctctaacccaagaaattggaatattccatcagtgataaatgctttggctaaaagatgctatttattgggtaatcctaacgttgggaaaacgtctctcattaattctttgctccatgaaaaatcaacaagtttccaagctcaacttgataagagaggcaacgttattggtcctccaaaaggccacgaacaaatacaaagtactcgccgtagggccatcttcaatgaaggtggagtatcacatattcccaactttaccagaaccatgcaaacttatttgatagaagataaagttgtgaacgatttaccagggtatacaatggatcctactaaagtatccgatctagcgaattatatcgagaaggaaacgcttgataacataaggaaaacctcaaagtttaagattgataaactgataaaacaaaattacacctctttgacgggttcaaaaactggtaaatgcctgtcttttggaggaatttttcatcttgttccaccaaattccactataaatcaggtggttaattacattcctcttccggagcatgagttttcaaatgtcgaaaaggctgttagcttatctctagaggtgctacagtcagaaaatcattcacttcgccaattttttgctctcaagaaaccatttactgacattaagatgtttgataggcacgtaattcctccatttaatggagcaatcgaaattgttctaaaagatatcggatattttcaagttaaacctactggaaaatatggtttcaatggtctttatgaactctgggtccctaaaggtatcagggtatgcattagagaaccgttatcaaaattgatatcaaaaagctatgaaaagtatattgaaagtggagacatcgccgatgtttgtccaaccgatcgtccactaatttcagacacctatattatgaaccataccgaagaagatacatttgccagaatgagagaaatgtacatcaataggacttcaaaagatattctctcaagaagacttcttcaaaaagatcccaacgatatagttggaactcttcaaagcccaccatcaaacttgtactggtattacaagtggtgattggatacacaaaactatatgcagcaatatggaaatagccctgtaaatagaaagtaagtagttttcggtattgagcgtaatagggaacaaagcgaacagagaagtatcatgactaatttcttttgtttgcttgtctgtttcttttactttccttgacatgttctctgcatgtgtgataatatttcatttctcaggattgatataagttgaaaacggtaaatgaaactattacaacaaaacttctctgatatccaggataccgaacagacgacttcaagacattaatgaaaatctaacataattcatagaacataatgactgatttgacgctgcgatgtatgcattgtcactcaatgttggaaatagacgtatccttgatggatctttctatggcccaacgtgatctgttagtatcttcagatgccaataccagtggtaaagactctagtgcaaacagcaaccaaatacctgcagataaactgaaagtgatgaaagaagtgaaacagccgtctcaacttcggttgacgaagccagggaatattgcatctgattcgtatgtctttttgacggatacagagtacagtttacaaaaatccaaaatagggggcgacgaatctggagatgaggaagactatgacgataggaacaagaccctttcgtcgagaatcaatgcgcttgggaatatttttaatatattatcctcgaaaaacaatgtagattatcctgtttgccaaggttgttgtgatacattattagaaaagttgaaggaagaatacaaccaggaactgaagaaaagagatacgtaccatgactttatgaaaaggatacaggagcataaaaacgtcaatggaattaatattggggataacagggctctagaagagctttcctcacttaaaaaggagaaagaacaacttcttcgagaattgcaacgattagaagatgaggatgagaaactacagaaggagacgatactgctacaagaagagttagctaagaaaaaggaccaatatatagtaaggttacaaaagcagaatattcaagagctggagcaactcactttcatcaaagatgtgcagtctctcaagaatcaaagagtggttactctcaaccacattgataaattacggaaactcaatatatacaatgaaacttttcggatatcacatgacggaccatttggaaccataaacgacctaaaattgggaagtgttccaaacgcatcagtaccatggtcagaaataaattcagctctgggacaagttgtattgttattatcattaatcgccgaaaagctatcagtttctttcacagattacaaattgattccgatggggtctacgtccagtatagaaaaatttgaccctaaaacaaatcaatggtttgttcacaaagcattcagtggggatgaatttagttttggatcccttttccacaaagaaagtgctattgacaaggcacttacctgcatacttgaaatcatcagtcttttgtccgccaaagtatcttcagattcccaggatccagcgtcaatagaactaccatatgaaatcttgggggataaaattaatggtttaacaattcttcttaatggggcaacaccttcattagaatggactacttcatgtaagtttcttcttactaacgttaagtggctcttggcattctccacggcgcatattgacaaaaataaaccataatccagcatccaccactttacataatctgatcttcagagagtacgtagtcaaataatagtagtccaaagatcagttcaaataactcaactgcatgcaccaaatcgctacttatataaaataggcttctgttctttcccaacgaagcgtttcttattcacatatgctgcggtttgattttcatttaattcactgacgctaagaaacgtcgaaaccttagcatgaaaatcaataaggtttaagaaaataaaaagaaccgaagacatcaatttcaaatccactgaatttcagaagaacttaactacgaaggggagcaaagagcagctaagtgatagtatattaagtgcataataaccttcagagataaaaatactttctttgtgaaccttgattttattggttagttatatcagcttcttttaggcgattcctggttgcctttttaatcattccctatgacggagaacatcgagctatgggatgcgagctcatcccataaggaaactttcaataaggacaagttgaaaaagtttttacagacattaactttcagtttgaatgcagaatatatcgaattggatacgttggtggaaaagattcttgtggggataccaaatgaacctacggagcgctccaaatttgtgtcatatgtggcggaaaccgtagccggttcaaccagcgcacatccagattattccatcttggctgcgagagtagaaattagagagttacacagaatcataggtgatgcaacttttaccgagaatttagccaaactaaggaaaattagtcgtgaagtgacagaagacgctacgaaaagacggaaaataactagagacttatccaaaaatttgatatcggacgaattttatcagtatgctcttaaattcaaggataaaattgaccaggcaatagacaagtcaagagattacaacttcacttattttggatggaagactctttgcaaatcatatttgatgaagagaaacaatgaacaaactcatgagactccacagtttatgtttatgagagttgctttagctattcatgggcccttcgatgatattgattcggtattagagacgtttgagttaatgtcacaaaaatatttcattcatgcttcgccaacattgtgtaacagcggtactgttaatcaatacttgtcatcatgtttccttgttgggatggaagacgattccatagacggaatttacaaaacgttacataagaccgctttgatctcgaaggcatctggtggtgtcgggatacacgtttcaaatatccgtgcaaatggagcatatatctcaggttccaacggaacatccaatggccttgtgccaatgttaagggttttcaataacactgccaggtatgttgatcaaggtggaaataaaagaccaggagcattctgtatatatttggagccctggcatgcagacataattgacttcttgcaactgagaaagaatcatggcaaagaggaaatgagggcaagagatttgttttatgccctctggatacctgatctctttatgaagcgggttgagaataatgaagactggtcaattttttccccagatgaagcacctgggctaactgattgttatggtgatgaatttgataagctttatgaaagatacgagaaagaactaattcctaggaaaaaaatgaaagcgcaacaaatttggtcagagatacttcaaagtcaaacggagactggagtgccgttcatgctctataaagatgcatgtaataaaaaatctaatcagaaaaatctcggcgttatcaaatcatctaatctttgctgcgaaattgtcgagtacagctctccagaagaggttgctgtctgtaatctagcatctgttgccttacctacttatgtcaatttgagttccgatggaccgcctgtatttgacttcgtgaaactacatcatgttgttaaggttctcgttaaaaatttagataggactatcgatgtgggaaaatatcctgttcctgaggctagaaatggaaatataagaaacaggcctttggctattggggttcaagggttggcagacacattcatgctctgccgtactccatttgaatcggttgatgccgcgactttaaacaaacagatttttgaaaccatatatcacgctgctatcgaggcttccacagaactagctgaactatttggtcattatgagagttttcctgggtctcctgcctcagaaggccagcttcaatttgatttatggtcattgaacaaagataactacaagtttttatttgatgattgggattctttgaagtcaaggattaccaagggtaaaggactgcgtaattctctattggttggcccaatgccaacggcatctacttcccagattttaggattcactgaatcttttgaacctatgacatcaaatatatactccagaagagtcttgtcgggtgaatttacaattatcaaccaatacatggtggatgacttttgccagttgggaatttggaatgaaaagttgaaaaatcgtattcttagagacaatggatcaatacaaacgatagaagggattccagaagaggtgaagaatttatacaaaaccgtgtgggaaacctctcaaaggaaaatgattgatttatccagtgatagagcaccctttattgatcagtcgcagtctctcaacctttaccttcgtgaacctaccatgggtaagcttactgctatgcatttctatacctggaagaagggcttaaagactggtatgtactacctcagaacccaagcagcttcaagggcaattcaatttactctaaatgatgagaacacgctcttagataaagtcaccactaaagtcaaagattctcgccctcttcatccaaagaaattccttggacaataccctaaacatgcaaatgacgataatcacaaagcagataagattttgccaattgaagatacttatggaattcatgactctaccccattggtttgtaacattattgaagggagtacttgtgaaagttgttccggttagtcagaaaaagttgtattttaagatacataacacacttgtaaatagcaatataaattgaaccctatgagggccggatatattaatacatttcattcaccgaagttgacatttaaatcctcatgatatactgcattagcaacaggtaactgttttcacaccgttgcccagatacataagtcatttcatttcatgattataaggagctaaaaggagaaattagcagcaccagttccctttctcgatttacgaatggcttcttattcaatcttactatctaaaggccgcaagagtcaacctatcaaaaaaaaaaaagggctggatgcagcaatccattgaaagacctttccgggatatctattcctaattcagtaatttatcatcaaaacgatcaacatgtcttggttgcgttatgaagaaaaagccgaggtcatacatcggatgagaactaccaacagaccaaaaagaacaaacactatagaatatccagattaaagttgttttggtatttctagaatgttgtttgaaaagaatcccatcaggcattgctgctactattctttctcgatttaagaaacagcactgcaacggtagttgattgattcacacttttccaacgctctataatatatatacaaggtgcaatatttcaatattactgtaatgctttcgaggttgcttctcgctctcttgagaacaatggcagccagcagtaatattgcgacgtcgagaaacggtaacctccccttgtgcatctacacttaaagtatttctaaataattgattttcagagtcattccatcttaccaagtacaacccgcaaagagtgtgatatcagggaacggaaatcctattattctatggcctcatttgtcctagtattattttctggttgaatggatatcctatttagtttccctatctcatcatatttaaatacgttaaaacagaaaaactggttttttctaagctttgaggaagactaaaggtgattacaggatattacctgacgatcacagttgcgcacaacagctagaggatagtaccgttgcgaaacatactcaagtgtgcataacgcgaagtccaacgtagtttcttttattgcttgagttttttgatattgcttatttcaggatgctttcaagatctgctcgttgttctagggctgttctcttcagtgccaaacgctctctagcttcccaggctaatactggtgctaatgccagtgctaaccaggttatggtatcaaagcatgtgcaagacattgacccagaaatgtatgacatcttgacgaaagaacgcaaaagacaaaaacattccatcactttgattccaagtgaaaacttcacttctaagtctgttatggatcttttgggttccgaaatgcaaaacaagtattctgagggctatccaggtgagcgttactatggtggtaatcaatttattgatatggcagaatctctgtgccaaaagcgtgccttggaattgtacaatttggatcctcaactatggggagttaacgttcagccattgtccggtgctccagctaacttatacgcttattctgcagttatggaaacaaacgaccgtttgatgggtttggatttacctcatggtggtcatttgtctcacggctaccaattgccaagtggtactaagatttcatatatctccaagtattttcaaacaatgccataccatgtcgactcacaaactggcataatcgattatgatttcttgtccaagacgtctaaattatttagacctaaggttatcgttgcaggtgcttctgcatactccagagtcttggattacaagcgtttcaaggagattgctgatgcatgcggggcctacttgatgtctgatatggcccatatctcgggacttgtcgccgctggtgttactcgttctccattcgaatattctgatattgttacaactactacccacaaatctttacgtgggccaagaggtgctatgatcttttacagaaagggtgttagaaaggttacaaagaaaggtaaggaagtcctatacgacttggataagagaatcaacttttccgtgttcccaggtcatcaaggtggtccacataatcatactatttctgccttagccgttgctttgaaacaagctgccactccagaattcaaagagtaccaagccgctgttgttgaaaatgctcgtattttcggcgaagaattagtcaagaagggcttcgaattagtttctggcggtaccgatactcatttgatcttgatcaatttatctaacttgggcattgatggtgccaggttggaaaccctgttggaaaacatcaacattgctgctaataaaaatactattccaggtgataaatcggctttgttcccgtcaggtttgagagttggtacaccagctatgaccactagaggctttgggccacaagaatttgcccaagtcgctgcttatattgacagagctgttaagttagccattggcatcaaatctcaagaatctccagatgctaaagacgctagatcgaagttagccagcttcaaagaactatgcaaggaatcagaccaagtcaagcaactagctgacgaagtctatcaatgggttggtgagttcccagttccaggtgaattataaactaagagatgtatagttgaatcgagcctgaagagcgacgtttcctagttagtatatgtatggcctaaataaaattagtttcaatgggttcatatacatcaacaactacaattgccggtactgacagcctctgggctctgctccaaatttatgccacctccttcattactggttgaggtactttgcggtacatcttcttgaagtagtgtaaatttatcgatgggtatgtctttacctattttcagaaacaactcatctatgccttctccagttttggcagatactagttcagcatcattccagttttgcaacgtctcttcatccacaagatcgattttattccccacaactcgtagctgcacagtgtctttcttatagtcctccaagtaattattcaattcatcgatccacgactgtgctttcttttcacttgctagttgtgtcacgtcaaacactatcaaggccacatctgtatttcggtaatacatgggtgccaatgaccggtatctctcctgccctgcagtatcccaaatttcaaaattcactcttcttttaatcccatcctctgagtcaacccactccatcgccttcgtactaaaagcagcaccaatagtggggctgttaatatggaactcgccagtggtaaaccttgtcacaattgttgatttccccactgatgattcacccagtaaaaccagttttactgtggaaatgtatgtcgattctgtcatgacttttatgctaattccacgtcaggtaagacaaaacgctactgaactgtattcttccgctgattaaatttacgtcttatctgcctttgattgtcttcgactcaaaatctaaccaggcattgatccggttgtaaacattctgcacttatttctgccctgcaatgccaatcctttaaatttcccatttttctttcatgtggaatctcaaataaagtacgcgtttgaaaccttttcaactctgttaacgtgtagatgagatgctgatgcaattaggaagaggctaagataatataataccagtaaattcatcgcaaagtcggtgtattcctttttcgataagtaccaaaagttggttcgtttaattgagtgctttgttattgagggatacgggtcttagatttattaagagacattaaatcggtatgatgagagatccctcgagaagaacgcgttcagaagggaagaccaaagcgttggatgcactggataaacatatgacgcagcgttctacgttaaaaaaatcattagcagcaaatgggcccaatgtgttggcactcagtgagagtttggtactgaatcacctaccgtcaaactctgaaaatgtatatcaaagatcgccaacgcccagacgttccagagaatctgatgtagtgatgctggaagataaatcaagtggtcttatatttgaggaggatgccggggagaaagcgcttttatcctcgccgataaggaagggtgtgtccttttcagatcgcgtggagagttctccaacgatgcaaacgatgggttcttcacctataaggccctcttctatgacaaaacctcctgcgagatcaatactgaaacatccttcacttcattattctaaacatgatagaccttcgagcagaaattctcccagcaaagcttcgcatttatctattgatccgtcttctacgaatttttgggtggagggagaaatcaagagcatgatcaacactaacaatgtagctgaattcaagaaaattctgaaaggcggtttacatgtcttaaatgtaactaaaactcgagatttcgagatatatgcgactttcaataacgtcattccctctatgaatggtgtaattcttaacgacattgtgcatcaaaagatcgacgttcttatcgagtgtttggacgaattacttgatacgagcatatatgctttaagtcatttacaggagtcattgttgctacaacagaaaaaagatccctttaaatcgaggtgttttatccaagtgattcgatttctgaccctactattctctaatttcaagatcattaaattcctagatggtaacctctcgctacaactgaagtttatagaggttttgaaggcttgtgaggaatctttgacgcatagtaacactaataaagtgatggtaatatacccactaactctattgaaggaagagaagtttggacagttctatttaccagattcacaaatacgacaattggtaaattcggtgtttacaatgaagtatattgatagcacgaatgttcaatgtgaaaggctcatggttttaaagcagtttttgcaaaagtatagcaaggtgatgttggaaactcttcgtacttggtttccgtctgaagtggcggcacgatatctaatggaagacagagtaacatccgccaagacaaggtcctgctgtaatttgatcatcttagatttactacggaagtgcatctccaatgacaaagtcagaacagcaattattgaaattgaatcactatcacttaagagcgttgtggaaaattgtccgttcggaacggaagtagatgtggaatacacagaattcattaaagaccaaacacttggcacagctttatgcaacaaactcatttctcttatgaatgacaaggaggagtacaaactttccatggacttttggttaggcatgacgggattgctattcaattcaaccaaaaatctgtcgttactgttagaacctgttggaagtcgttggttggcggttaatgatgtttgctttaattccaaaaaatcaaatctgagaggcatagctatcaagaataggaggatattaaactatatgattatcactactattacgcatgatatcgataaccatgttttggatgcattgatacaaattgtcatgaggccctttgagtttccggacaatgaaggtttatcagaatatatcattttcgccttcaatagtataatgtatttgacatgctgcgattataaggatatgagctcaaagagattcgctttgcttttcgaagttattcttaaacctcttttccagagaataaaccaaccaactttattgcctatcttgggacctcaagctcaccaaatacttcccaggattattcgactcttttcagatgaggaaaactcatccccacgccgatctataggattccaaccattgaaagctttatcaacaattggtatcgacttgcctgattttgagcctatgagcaacacaatcctcgaaaataactggaattccatagtagagttgctcaaaggtatgattgcctggcctgggtttaattctcagaattcccttatgatgcttcagcattgcatcagaagaagtccgtctgtcattcccagtaatcaagcttgtgctcaatccttggagtacctaaaactaattttagaaaagggagagatcgatagaaatgaggaagtcttcaaaactattataaggagcttagcggaaaagtatgaattgcacttattcagcaacagctccattctcttaactaaaatattcccaatggaccaagttacttcagctgtccaatttgaaatgtttaagaatatctttcaactagttaaaccctttgtcaaacctctgctactattcgggtatttcgacagatttagcaatgatttgatatcaaattatattgctaatatcgttggatctatgctgatacctacgaatatgtcccagcaagaatataaaagtctcttacagatagtcaataaaatgccagtacctgaagtcattgataatttgtttacttggctgcgtaaaacggacaactggggaagtattgcaggtgaattgaacttatcaacatggaatgatcatttgtttgccaactttatccaaaaatggattcaagaacaaaagaactcttggagtcaagaaactgtccgcatgttgactgaaagtctctggaatagaccagcagcattcaaagagctgacagcactgctgatcaatgcagaacaaactcaaatcattaaggacacccttgagaaaaatccagacattatcgatgatatttcaccattaggagatttgtcattattggatatcttacctgcaacactggtaaaatcctcattttccaaaatacagcagtacgatgatgttattaaaaccaagcttttcttgtgcatatcaacactcgatgagattagcataattaagtcgaatacagaattactataccaattattgttacctactgatgatgatgtgtcccttaacaatgacaggaatatcatcatggatatgttattgaaatcttcaatagggcatcaagactgggatttactgtccatgttattcgaagtttgcttgctacgcagagattcagacaaaattgttgacttcttgacagctggaaagataaagttcgaaaatataaaaccaaacacaattgctcggatgataaatgaaagtggcaaactcaattcggatcttatcgatttcctcagggatagttttaagaatctaaatccctcttacgttatcgatttaatggagcagctattaaaacagacaaaatatcaggtatttgatataataacggaggagttactcagtttcatatttgatataaagcaacaattatcagctgatgacaaagaaagattgaaaggaatctttcctgctattgtggactacttcgttggaagcaatccaaaaattctcactgatattatgaaatatgtagttaatatcatgaagtctgcgaaggaaaaacaatatggaacttcactaatagtgctctttttaaatcatcctgatttcaagatacaaggtaataagactctgttgaaaaagcttaatgtgttcaaagccaatgcaaaaagaaactcgactcgacaatacaaattcatccctccaaaggaaaataaaaaggtatcagatcgtgagacgctgcaacataatgaacagcaagataatacaaatatttttcctttatctacattatctgttatcgaaactaaggtaacttcctccgaagagcttgaagttccgctgcaaacactttcggaaacttcagatgagctaattcgaacggggtgccaaaaagtcgttgagcctatacaaaattctaatgacaatgaaccagtaaaaatggctgctagtgtacaatccgaaaagcttgaagcagaaacaacgcagaatgcagtgtcacaagtttcatcaggggaaatggaaaaacaaacgccttctattaaagatagcagcactgaagtcagcgaatgtctgccaggtgttgcaaataatgatgagatatctaagaaccttgatacagtgacaagcgttaactccccatctgggctgcctctgaagataccaatttttaatcctttctttactgatgttatcaaactcgaagaggatcttgcttcgaaaggcgatacctatatatcagggaagcggtctttagaactgatgaactcagctggtgatgttgcaagtgcaaattgtgaaggacagcatcatacaaaaaaaattatgcgaattgtttcaagtttaaatgatgtcgatattgatgatgtgaagtctttaagcaacaacgataagaagcttttgagaaaggtaatgtataattttatgttaaacttagaagattaaggacatgttgcagtcagatttttcctatccataacaaaaatatttctcggaatgatcaatttacgtaaacaatatctctacagaatacagttattcttttgaaaaagcgtctccattctaacgggtcaccccgtttcctttcaaaagtaacggatttcagatcaccttccaactgcatgatgactagagatcctgaaagtgggagcttatttctatcatatgttttgagctgtatagacacaggataggggttactctctccgatctgccgtttcagttccaagaaattatcgtgaagatttctactcactctaacaccatatgcaaccaaagcattctctaggtctgagaggattacactaatatcatcagtagagaaaaatttagttagcctgtcagatgaaaagttaggcattagcttcatatcattaatattaaactgcaaggaagcgagatcttcttggattctcttggttgaaaatggctcctgcgtcattaattccctttcacttgaaaaattcgtgctgcatgtaaccttttgagtggcagagtagccgtttcgcaaattagccggtaaactatctatatgtgcaagctcacgattgagaggttgggtgaacgacatctttgcatgttgattggcaaacacttcctgcgtagaagataaataatcggcatctgatagagaaactttaagctttgatagtaatttttctgcaagcaaagaaggatttttacaaaggccattttcatctgcaaatttcggatttgtttgataccatgtatgtttccgtaaagtatccaaagaagctcttttctctggatctggttgtaatatttttctcaagagattcaattcaacgaaatctatcttcagccaagatccctgatctagctttccttcgcctttaataaagtttctaaacgtttcatcgtcctcgtgaggaagttcccaaggcgtttctccagtcaacaaaacgaataatagaacaccaatggaccaaatatctgtcatatcagcatagtacccatcacagtatattatttccggtgccatgtagggaagacttcctcgttgatctctagaaatacgttttgatccatcttttctcttgaacagcgatgctagcccaaaatctgcaagttttaaattcccatctttatccaataggatattttccggcttgatatccctatgggcaacaccacaggtatcatgcagataacttatagcttttataagttgtttataatagaattgggcgacttccgagtcgactccaatgtcaggttcgattttatcgaaaagatcaccaccttcagccagttccatggctatccaaagaaacggatcagaaagattgcaatctataacctttagcacattaacaaaattagagcatctagaatgtaacttaacttccctcaacacatcttcctgactcataccttgtttctcacatgaaggaagatgtatgaatttgacagcaattacagtggacggatcaacttctaaactagctctcttcacaaaggcaaaggagcccttcccaattgttcttcctagttgtaatccatcaatatgagggagctgagctatctgtgaaaagctcatcaatacatcaatcgaagtgttcttcttttacttcttttttgttcttgtcggttcgtatctcagaaatctccagctatatcagccaaacgcacattcaatatttacgcaactgatgtgctcaaaatatcatccaaccgtcctaactgaaccccaagtgatttacctaggataacacgtcggagactcgtatataaatcccgttttccccataagtatcatcataaaactattgtttttcttttctgatcagatctgcgatagtcattagtttctgtcatttctttgcatttataaaaacgtacattgaaaggggttttactacgtttatagtttaatcagtgaacaataaacaaatccgatactgttgatagaagcaacgaagcagtggtgagctttttaggagtggtaagtgtaagattaggcaaatatgaatacgatggatacactggatacgcattttgtttcctctgtggaaaatgcggtacaagaatcattgcgagagaacaaggcgttattggtttatactacgggcggagataattcgtggtttgagtcgtggtttacaccacttgtaggggagcagttgaaggattcgtgcgtttggttacgtttagctgctggaagcagggaaatgggttactttgagcaaatattcccggatgtgaaggttcctagcgtttattgtattgctaagggacaaatagtggagatgataaatccagatcagttggacatggacggatttgctactaggttgatccgggcagttggtaaaagcaagaggagaatctctgaaacggatgccgttgatgcatccaataccgttggtgccgctggtgataccggcgccaggtccggtagctgtctgtcacaaaatgcgaaattgatggagtaccaaataaaggccaagaagcaccagttgacagaacaacaggaaagagaacgtattgttagattgatgaaagcggaccgtgaagaaatgaagcaacgaagattatcgtcatcatctccaaatcatactaaggaacacatcaatgaagtattggctgtacccattcacgataatattaaaaacagagatataataaacgcagcagtgtgcaccttgcttataagattaacagacggtaagacattgaaaaacgatttcgattcgtctcaaactttaaacgatgtaaggacttgggtggatgccaataggacagataaggatggtccgtaccagttccatcgaagtattccacgtgaaactttcacagaatcacaagaattactatctttgaaagctctggagcttactccaagatctgcattaatcttgaagcctttggaaaagcatacatattctcgtaagattgcagatgtagaaggaccaggtttgcttgggaaaatgtatcagaacgtgacgtcctggtggtacggtaaatcaacggttgttgatcaaaatattcctgaacctgctgaagcattaacatctcaagcttcatctagatatgtttctcccttatcttcccctcgtctggtacactctgatgcatcgataccctcaagagctgtctctccatcttctatacattacggccatgtctcagacgacaacagcagatagcacacctgatttatgaatcgcctttatgttaaatatcatatgtatgcatgaacgaattaaatatacatattaataccaaatatgagcaatcactcttatcggaagaattaggccaacagtttctcggtcatctcttcctttttcggttccttcacttccgtcttctctgcacgaggagagtccctgctcgataccctcaaggatccaagtttctttatcaaatcttctgttgagccagattccaaaggtgctgcagatttttgttcttcgatcttctttttctccttctcttttgtatcctctgttgatagctccttctctaacagtgacaattcttcttcaagagcatcattgtcggaaaccgactctcctactaacaaattatgaatacggtcttgcttctctgtattttcttggaaatcatctaatatgtttgaaatagaatcttcatctaaaagttgtgaattgatagccttcaaagcggtactgccttgttttaaaagattaatcataaccacattttgtgaagcattggatatttcatcttggagtttcctaagagattctaaactcgtgtaagcttgttccaagttcttttctgagcgttttttcaacctaagaagtgttctcttaatctcttgagaaagacccgatgaaatagcgcttgtcagccgtttggtagtaagatctagcaccttttgtgccgattttatctccgtttccgcagtgaatacatattcattaatattggcaacacaaatatcttcttcagatacttctttggacgctacctgggggctcgcactcaacaacggagagataatcttaactatattttctgaaccgacaataatttgattcttatcacataagtaatcaagtattattccgtaggagtcccaatctttcacgatgctatcaattccggacgccttataaaaatgacccttagtgaatacatagtcagtcgctttgtgagcactttctttgatgttattcttcaatagatcttgtagtacctcgtcatttctctttaaccacgcaatattaacatatttgactggttttaagtacattgcagtctcattttttctgctcttccaggacaaatctaagattgtcttgctgatagcccagctcatcattgatattacgatgttctgattccttttgtgatattcgttaagggatactaacgtgccttcttttaccatctcatctagcactacgtcaatgcttttcggagcaccatactgagagtttgataattctgaaagtagatctgcagcatttatgattatcagatcactccagaattccttgattaaatattctttccattgtctgatgtttgcctcataaccatcgatgtttaataatttcagtcctctgaaatcagagtacaatgatcttaaccttgattctggtaacattattgaatggcagtagtccggaatcaggatgcaatcctttgtaaccccgatgtcaagaagagttgcagtttttatcgatctgattttcaatctgatttctcatctcaggcggcattagtttcaactttagaaaactcaatgcttaacgaagtttgaactttagaatttaaggaaactatttctggatattggaagcactaataagagtaaagttttcattggctgactaacattgtccaaggtacggcaaaagtaacaaagatgacagatgtgaccaaagatattgataacttggctgatgcccttcttacgatggagatatcacccgaaatcaatgatttgatggaaaaactagccctaaatttaacttcatcgaacaaccttccggtagacgtcaaacatctattgacttcaataaaaacctatcttacacagtcatcaagtgagatgttagactataatttacttttggaagtgttggatgcagttgtgggcttgtgtccgtttgaggatgtactcaaagttttttcagtagatgaccttatcactgccctcaaaagtggtgacaaggctttaactgagacggtttgccaagtaattgcggctgcttctccaagagatatttttgcaggcacacctttgctagatgaaatgcttaaattgtacttctgcgaatctactgttgttgctattgttaatgcgcttgagaagacgcttggcatcttagttacgaaccaattaaacagaagaagaatcttagaaaataacttaccggtattaataagtgttaaagactgtaaaaactctactactttttgtaggtttcttgatttgatcaagatactctctgcaagtgtcacttttgaagagtttagaaaagatatcttcattatcgacaacatggtgaccaacaagatgatggaaaatgatatacttgttttcattcacatatgccaatattatattgagcttctaactatttccttgacagaagacggaaaagaatgggtaatacggtatgtaaagcccagttttgaaatatttggagaagctttctctagaagggaagaattgtttgatgttggtcattttgcaaaatcgtatttgctaacccttttctctaaaatctcttacctagatgacaaatcatatattcagctgctcgaagcgcagttcttcccattatatcctgacaaacaatacctggacgaatttttgacggttcttgatcctagttacattgcaaaggttcatttggacttgttaaaagaaaaagcattacgtgcggggaatgttcatatgtttgtgaatctaataaaagatgaagactgctttgtgcaattaaaagacgaaataaattctaaaaccttgaacgatatgccatacatagagaaaatgcttttgttagacggtctgactttaacttcatatggtattcaacacttgactagaaacatgccatcagttatgaacagtataatcgatagtggaaatcaggttaccgaaaaattgtcgtttgacttaagactgagggtcttcgagaaccttttggaagccaacccgcaggagttgtccgtgtggttgattccgttgcaatctgaatatgctaatattctaaacggtcgtcgcggtcgtttctcctcaggacaacttgctgatgattatctataagacatagattttgatgaagttacatatctttatatatatcatagatacaacgagccagcagagacaatatctctgtgaatgaggtttaatgccgcttccatcttttcctttaatgtagcattaccaattgttttagacacatcgattagttccttgatcatctcttctaatcttttgaacattctgatgagggaaccttcataaacatctgtcattttgcaaatttgagtaaatgatgcaccttggcaccactcatataccacctccataagctcatgcctgaaactttcaacatactctttttcgactaattcaattttggagtctttgattattttagcaattttacctgctacttctctcattgctttcaatggctccgcaagttcaggcttcaaccttggggcctctttgcaacgctcttggaatgcgaaacatgataaaagagcagcagcttgagcaggggataactcgttgaaattaccattgaagattaattctgtcaataacaactcatcacccgaggaaatttcgcaggcaacacgccccttcaactctatgatatcggactgtgtacagaaccctaaacgacgtaaaaccctcttcctgcgacgcaaatcgtctaattggatgacagcttgtgcctcgttgattttatgcttcaaattcttgatgtctgcctcaatggccaccttgtttgagtatttctcataaagctctcttaatctaacagtatttgtcaatgggtttgagtataaccttccttccaatacttcgatcttctttagaagctttaagaagtcatcgtcgtcaattttcatgttcttcactggatcaacaatcggtacaccatctgggaaacgacgcaaagcttctctgagagttttccctactgttgcttgttgactttcagccttgatatcatttggcatgtacaaccttatatttccgatagactggattgaggagagagttataggaatgatggtacaagttgatttctctccttgttcagcaggtctgataccttcggggaaagttggattaaatggtttgatcaagttgatcggcgagtcagcatacatagtattgacgacaacattaacaatgtaggactcttcatcagaatagactgcggtagggttacgtttgttagttctcttgacaaaatcgacaacagctgcccacccgtaatcatatttgttgtcaattttcacatttattagtctaccaggttgcaagaaagctaaagaattggcagggtgtgtaataatggtacgcacatcttcgttatacccatccaacgtttttcggatttcatagtattctttcacagctggttcatcatcaactttgatggattccagtactgacgttaattcggctaccttcttttccatgactggaacagaaatagcgttttggaactggaagaatgaattttctaacatgaactctggagaaataccttccacacgcattagattcaaaatcatattataacccaaatggaaagcggagtccaatctgtcggcttggccttttaccatacctttagcgacttgaggttccatcttttcatcgatcatcataatgacaataccacggtcgtctaaaccacgacgaccggcacgaccagacatttgaatatattcaccaccagacacccaacggaactgttgaccatcccatttcctaacactcgtgaatacaacggtcttggctggcatattaagcccaatggaaaacgtttcagtagcaaacaagacctttaaaaacccttcttggaagagaatttcaataacttcttttagaataggtagcaagccagaatgatgtataccgatacctctccttaacaatggcaaaatgtgtttaatctgaggaagttctctgtctgattcaggaagaagatcgattgcattcttaaagatcttggtaagggcttccttctcttcctcagagttaaagtctaatttagacatcttcaaagccaattcttcacagtcacgcttactgaacgagaaaacaataacaggattatattttttcttccagatcatcctcacaattttgtatatatccccttttgcatcacctttagctgcgccacctttatacgactgcccctttttacctctgccattgatagtgtggacatcgtctccagtctggttgcttattgaagccatcgctttctggaaattttcctctctaaaagtacccttttcatcaaccacgagatggataccgtcaccatgagctgggaataaataatgttgtaatggggttggacggaagtccgtgtaaacaatgtgacatggttgggagtgaattctacagatccattccgcaaattccatagcatttggaatagtagctgaaaggaaaacataatgaaccttatcaggtagtaagataatagtttcttcccaaacaacacctctttctttatctctcatataatgcacttcatcgaaaataacccatgcaacttctctcatgacttcactacctctgtaaagcatacttcttaaaatttcagtcgtcataaccaaacaaccagcatcaggattgatggtaatgtcaccagtcattaggccaacatctccaaattcagccaacaattctctatatttttgatttgacaaagctttaattggagatgtatagatgactctctgtttttccctcaatgattgggcaattgcatattccgcaacgactgtcttaccggcagaagtatgggcagaaactaaaacagattccatgcgatcgatacacgaaattgccgtatcttggaaaggatctaaagtgaacggataagtacgtgcttcgttggttctaacatggtcaccaatcggcttgtaatcataattaggtggaagagcaacttgatgtctaacctgatgcctcaatttcactttaccatcgctttcaagttggaccgtttgggtatttccgagccctgcagatgcttcgacttcacgagatgcctccctttcgaaagcatccgctacaactgggatgacaactgatttattcttcttatcctcgatcaaagtgattcccatcttgaccttcttggaagatgaaatatctgaattctggagctgctctgcatcatcgccattagaacgtttggtgccagaattcttcacaactgatttttcgttttcagattcttctaatgcttctggagggagctcaaagtcttcattgggagtctccccgaaaacatcgaataacgagtcagacattgtatctcaacactacttttgttcttcaaaattgaacaggctaaactaccctgttttgaacaaattagggaaaagcactgaggttagttgaacttcgcaaatggcagtttatctttccccttatgttattattactgactgttactaaagaagcagtaatcacctttataatgtatgatacctcttttaacctcatctcatctcatcgcatctcatcttacaggttcttttattcaaatctttcacaaacataggaaaaagaaaatatattccgtaccgtatgatatatcacgtgcctcaacctttcagttccgaacatgcatcataaagtcatcagtgaaaggtaattcaagccatgggaaaccaacacattaatgctatcacttaattagatgggtaaataaaacgatagaacaatgaatggatgaactgatcgatttatatgacgataaacgcactttgatttatggtggtagtgaaatattgtgaagacaatcacattacactaaaacaagaatggcgtagtttatacgctggtgacctatactatccctgatcagatttgcatatgcagacttgagaaaagtacagctggagacgacaagcaaattaatgttggtggtgttgtttcctaaaaaatatcagtatgtaagaggacatcggatctgcagtagaaaacgaaagataccaacaaacctaacgatcacctctccttcggttagtgaagaaagaatgatattgtcacccgagaaatgatggaaccacgcctacagccaaatagattatcaatatttatcagccaccctctttttcagcacaaaaggtttaaaaaacggatatggatttgaggacttttcttcaaccttactgaaaagccacccatactgtaggcccgaacgaggatagaatcgaccaggacgttgataaagaaaatgttcaacgcttgattttcttcctcttcatgtggaatttgggctactaagcaaaggatactcaaccttacacagaatgtaaaattgatcaatgcagattcaaagcgcgggaacgtccctcctccagttataaggtattgtacgcagcaagatgcagaccttaaatttatttgtaaactgcatacctgctatgcgaaaagctttgggttctctccgtggtgttcactactcctgatcaaagctttctaatttttgtgcgaatagctcgcgtatttgaagaatataaagtgcacctacaggaggagcttagtaatcctatgtgagaaataggtgagtatcatactcatttccagcaaaatattagtcccgcaaggaggtgagagattcacgtacttctgtacatagacaccgtattcgggtggcgcccgaccagttcccattaggagatgtcaccggccaagttctctccgctgcttcggcttcagcatcatactccagctctccaaaatcctaaggttctcatccaaggaatcgaggtattcaatggcacacataccgcagccgcaactaaaaaagtcttcattaaagtggtcttttgatgagcttagattagctgcgagtttccgagcgagttatctacatccactagctggaaacacctacagtgatcctcataacgatgtcttgctgcctccaaatttaacgaagaaacaaaagaagcccagaatgacggaggttctgccttcttactttctgacgggatttcagacaatgacgctaattgtgagaggaaacgcgaatggcgaaaatccttagaggaagaagattacgtcgattttggctgcagaaccaaaaaggtttccagcactcagctcaatggccctttagttttttcgtagtacgctatagacagtagatgtcgaaggctgttcttcaatctgtgaagttgttttgcaaaataccttttcattgtcaagggcaaattcaggaagcagaatgatattggcaattaatatttcagtggagagctgagaagatgaaaaggaagatgtggaattattttgtctgtttaaccgccaaaaagcgtttgttctatagaatttgatattgattccactgataacagggataacagtgactaatggcacgcacgagcttaccattaacgtccagttttcagtttccttggtagtaatatataattaaatactatgattttaaattgttacgtatattgacttttgaagaataagatacttctgacgtcatccacgttaaggttgcccgtcggacatgctctatggtataccactgacgatgataacgctatttgggaagctttgttatttggtcttccattaataggtcatttctggtttgaaaatttgaatcgttttatatttttggcctacattcaaagataacggactaaaagtgaaattataggaaataatgctgattgataaagacaaataaaataattacatattaacggttaaatcgacaaacctcattgctcgaaagatacaagcaatataagttctcttatgctaagattgaaagccatatatgacaaagggatactttgaatgcaaaggaatcagtgtaatatttaagtaatattaacatcccgtctcgtttggcgttttctaggtgttacttattgtggatctgctgtcggttaagaagaatcgagagcttttccctatcgtattcactcaaccccgtgtccattccagaatattccgtttctgcatggaaactcaaggaactaccgaaattaccatcttcttctttgatatcaaacgattctaaatctgatggcgcttgaagatcatcaattggacaatctgcttttggtagattagtagtagacactctaaaatcgtttactggctggtatatcgagcttcttcttcttgcgttgagtgttgatattgatttttggggtgaatgtttctgttgcagtgaatgtacatatgacaaatcaatgttgttaacagagttggaatttgagtgttgatgttgatggaagcttgttagggttaatgacttggagtggaaatgcatgttaccatgtgattcttcgtcgtttctcaaattagttcttgaaagtctttgacttagtcttttcttcaacctagttggcgatgattgcacagaacttaattgccttgagttattgttacttaagtaaagggatatttgggaatcgtctcttccgtcttgcgtagaaaacgcaccagaattgaacttaataggggttctgatggcagtgacaattgatgaaatggactttgttggggaatgttctatgtgggaatacaacgccggaactattggagatgtgttctgtttcaagccttcttccatcaacccagtttcatgagggtgaattgctctgtcgacaaaactcatcacctcatcgtcaccgtcgtacatttcatggccttgggggaaggtagtctttttcagtgggaagctgaagctggtgtcaatatcgaaggcggggtataattgatcagctggttgtgtgtgatccttttctctgttcaacagcatgtctttattcttgttccagtaatcaatcgtaattgtgctgttaccgatatccgtattcaaggctggctgagacactgagttttgagtagaatatacggcgtgctccggttgaatttgcaaatcattttctagtaattgttctaaaacatcatcactttcctcctcattttgattcgacggagccgaatccctcatatcattgtatttgactacttcgtttccaggtggcgatgaattaactgtgggctctaatgctttcggattatgcaagatagatgggagtagcacactattataaagattaattgcatccttttccattttcaggagattgccatctatatcatcagagtcatataaacacactgacctcgcactattaacttcgttagtttgtttcagtatgttaagataacttttagatacatctggaatggttgatagtcgcgtgacgtacttcgcgtctatttcagtttccaaataagaaatggattcaggggtccttgggttagaaggactctgtttatctttatcagtaggtgatttgatggagaacttcctctgtattttttcgaaaacctgtttctttgatgtgggactaatggcggtgaacgaggaattttttaatttacttttgagcgtgtggttggatgcatctacgacgctttgataaggtagcttatgtttgatgacagaaggtgttgatgtagcatcagaaccggaataattagttgggtattcattcatccagtttttttcgatagcgatttcaagctcaggtgtcagcgtctgtgcacttgcctttaaggaaacgaatctctctctggtttgattgcacactttgatatctcctttagcgtaggtagtaggtgcctctttttcgacatcagtgacgttttgtttcggaacaggttcgagcataatgatattcaattgcattccacccaatagcatggcagccagtagaactcccagatgtgctctcatcaagggaatatttagctcttctatcttgaaattgtgcagcaaataataacagtgtgacacagacgctccgaacgttaccagaatcgttatagtgatcaatgtatttagagtttttagtaatctgtatcgcagacctaactgcatcaattggcatatgccgcatagcatcgatgagcacgcaattataataatactagacatttctttccaatagcttcgcagacaaatcatagcaattgatagacttccagtagccatgttaagtagagatcctgttagcacaatgcattctcgaaggtatgaaaccatgacgaatggatgtaaattaaagatcttgacagtacttgttttaccagcaaacagcgagaagaatactcagctagcttaggatgtcggatattgttaatataaagaaaacaaaaagaacaattaatgagacacacacgttaagagatcagtcccactatattataatgcttgtagtatgatgttccttgaatgcagggctgtcagttgaagtcaagtacccttcgaatatagactccataataaacgaataccccaaatttgattaagacaatgtgaaaggtgaaaacaaatctcatatcaaggtcagcaaatatattatacaggcagctttccctctttcgtctggcctcataccttttgttttggtttgttgacatttagacaatgagattgcttatatttaccgttttgcccgattgggaaaatttggtaggaccgaataatgtacattgaaaaaaatgaagcattcaagaggtactcccgaaggctgcaggaaaagaagggcgcggaggatgtctacatatgcagagaacagagaaaacttcatcaattccgagacaatggaacgatagggatatcgggcagactctcagaaaatgtctgccttaactctttgtaattcattctttacatttggtacagggttgtatattcttgtctctgctttgatcagactcatatttaggtcaggccttgtcaaaaatcacatcaaaaatcgcatcaaaagcagtattcagtattgttaaggaaaatgatacatagcaaaacagaagaataccaaagacaataaggtgacaattctacaacggtactgtgaccgctgaaagatgtcccggtacatgaatcctgatttatatttttctccagtctatttgactttttttagtctttcttactatggctgcgaatgccatctggaagactatctcattttctttatcttaaaagtttcaaaagaaattacgtatattatacaaatgaagctgtgattaaagggaagagaagtacaagttgtggtgaacagctatgcatataatattggcgacatacgtctctttcgtaacagaagttcatagtagaatacctttgaagtagtgcccatgtcgttcttgaaaaccatactcaaaacgaagaagtccaaaaagtttggaaacgattctccacgactcatccaaggaaccacatgcgaggtagagattgtctcgaaatcagacggatcaaaactagcgctcaagaagttcagatcatgggatctacataaccatcacaaggaagtttgtgtgaaagaatatgaactactgaaaaaactgaatcataaatgcattatcgaagctcttgattgcaacaaaaggaaacatacaatcacattcccatattatagttacacagttttgtatttgatgaaaatgtccatgctaccgaccttcgaggaaagagctttgtggttctgtcagatatgcgaaggtattgcctacttacactcacataatattgttcatcgtgatttgaaattggagaatattatggtcgatgaatctctatgtaatattaagatcattgactttggatcagcggttgatgtcgggccaaacaaagaagcttgccatggaattcgcggctcggaacagttgatggcgccagaagtctttcaacgtcttaaatacgaaggtactccggttgatatgtggtcgttaggaatcatgatgtttgaatttttcaacaactcgaataaacctgctttcccgtggaaaattgctaagatagacgatgtagcattcgaggcgtatacaaagaacccaacaacacttaatatttccattgacttatgcatgaaactactttcggtcgatgtaaaacaacgtctgtctattcaggatgtcatcaatgacagtttctttcaagaaaatcataattccgtcgatggtgtctcagcgcatgcaagaaccaaaagaattttagaaagatcacaaactacatagtcctgtataacattatttctgtctgtttgaaatacctcctcccatcttcgtctattatcactaaactcaaataattttttacgttgaagtaattacaagtcatgtttggagttaggtcatatcctccaaggaacaatctgatgggaatagtctctcccttgactggagagccgtccatgatttcatatcttatcgaagtcgtatctgacaattgatttggttctgtcccgcatgtttcccttttgattagactcaattccatatgttttacttttaatctggtaagcagaaaatatatccttccaactataacatcttttaacgtgtgttgtgcctttgagtattcgaactctatatgaagacagttttcaattccgatatctaattttattggtttaccctcattatccttaatagaggattcattagcatacctatgacaccagaacttcttcaattttactatatcagccgattttcttatcattgtaactttaatataatacattacagatacgttcttacccaagtaactttcaaatcgtttttctacatccttaaagttgaatttgtaattaacagaatgtactaattcaccaggaggacacaaatccatgcttaatgtcaaaaaggtatctagatttttattcttcacgtcgttgttataaccagttgtatcaatactaccaatcaatgaaactttgatacctgaatgttcaagtttcttcccttctctgacacgcagtgttacaagcccagtcacactctccccatcttcaaataacggatatttatcaaataaactctttgccgagtgagaattggtagggatctcgacatgttttctcgaatcctcaccatcaaataggatttctatatcaactggattcttgtagaaaagtgacatattacgttaagatttcggcgtactccccacgaaagaatcaaatatagtgaataaatagatatctattcaataacaaaagtgacaaaggaaaactttcaacacaatgcggatcttattaaccattgattttttttaaggtatgcatgcttccttaagtgtgttctttcataataaagcattgtatgttgaatagcatttcatgctgatttctgaaaacatcaacgtgaatcgttacccggatatatcattatcttgcatgtactcaatcattattcaaagaggattttgaatacacttgagtactgcatgcagacgatatgaactatgtacagatttaatatgctttgaattaattgattaacatttcacttgttttcaggcgataactcctgcttcttactttggtcttcttttaactgaagagatggaacaatggcaggttcgaccacacgaaacttttgaagcactctgtcgtcaccttgcaaaggttggacccattcgcttcctcgttctttacctgattcaacccaactcttcggccaatctagttcttcgtatgcactcaaatctaggtccgttgttgtgaacggtcttgatttagcttctacgatagctagagtggaatgggaaacttgttcacaaaggaatcttttctgatagaatcttgcaatacgagttggaatagtagtgaatccacttaagttaggcactgcaacaacgagaagaggttgttcgaagaatgcaggtgcacctgttttagggtctattatgaggggtttcgataattctgccgggatggatgcatttgcgtagtcagacggaagaatatatggttttgagattttaggtccttctttttcttctgaggattcatctggagtagtttcaataggagtattttcagtaggggtagtttcagcaggaatagtctcggcaggagttgaatcagtatttactgctccagtctcattcatcgtggtacccacagttgctgccgcaactgctgtttcagctggttgcgtgactgagatttcctttacagatggattttcagttatcacagcagatgccgttgtatcggtaactgaggacgcatcgctttccacaaccttcggtggctcttctaagggacctaaaatcccttcatgtacaccagcaatgtactccttgtacgcacctcttccaacgcagattacacctccagccactgatggatccaatagcgagtcctccgtaacgacaggttgaggctcgttatggtagaatattccaagcacggatctggtatcgaaagatgcggctgggctttcttctgagacaggatctggggtagtggaaacaccacggcaccatttgaaccaatcgagccaagaacggcttttctttgactgagcatcatgttgttgctgctgctcctgttcaatcaattccttacgcaactggcgtactcttgaagcgatttcagttctaatttcgccctgcttggtaccactaacaatttcataatcgagtccacttgaatgaaggataggtttgatccagcgtctccaaagtttcaacgacgtatccaaataatcatttggtggcggagccaccaacacaagcaacttcctaggctttacgttggtggacaaactggaagacatttcatttctaacatggttgacgtacaatgatctaatttgtgattgttcgtatttatcgtaagcgataccggaacccgcaacggtgaccacagtaccgaatgccaaccatccaggtgagggcagtttcttccacatagtatgtattggatgatgaacgtggaaggtaatcacacaatcaacaactgaaacaaaaaccaatgaagacggtgtactgccggtggaaagtatatatgcatgtccaatagaacattcataacaatttgaaaattcggcgatggggccttttcttcttattgcattggaaagttcgaaggaatattaggtcacgtgaacagataaaccgctacatgatcgggtaacacctattgtccaaaagagaataattcatatgtaacacgggtaccctgccttaagatccacagtcgctcataagcgatcaaagatcaagaaaattgaaaatggccatcaggaaacggaacttacaagaaccctaacataacctttccagtactttggcttccagaaatacaagtacaaccgtcacctgagatgatatacgtattcaggtatccattatcaacttaactagctacgttaagcttgcacatcgaccatatggccaaagccaggctatagaaaagcccaaaatctggttacgactaatatcgacatagcgaattatctttttcacaaccgaagaagaacctatcgcagtttttttgtgctttatttctgggatttcggagtactgtttgatattctggtgtgaatctgcggttggaaccatcagacatcaagagccaattgttcatccttcacttttagtctttctcaagtcactttcttttctctttcgatactactttagttttttctcctgctttgacatattccaacggaaactggagaaaaattgtactcatattgcaattctgacaacgcattggaaataacttaaaagacaaattgtgatccatccctgtgttatattatctttatcgcttgaacatttttctttccgtttgagctctcacacattgtgcgcatagtccactgaaattcggtattttgaaattttgaaatttaagactaaaaatcaaaactcatcatcatacggacgacagacaacatccagtcatttcaagaatttactgaaacttgaagggattcaaaaacaataccagatagatagcgctttaataggcagaggcacaaatagatagtcgactgttatcaagatttcaaggagtatcagttgtatttatctgctcttctttaattttattcctttcagcttttgttcagacagtttttgaaagtttggtacaatatcccagaccagagaagcgatacagattctgatttaactttacaagtaggtttgcggatatatttatcgaaaggaaagacactaatagttacgcttagatttacatcgacacttttcttccagttttcattggtagtttattctttttgtcctttgtatgtgcgatagttttaacaagcaactgctgcagatgggaggaaactcggttcctgctcacaaaggtgttgttcatggtcatatccacaattacaataatttaacttatatccacggtcacattcacaagaacgatgttgaagatggagctgtaccggatccagatgatgttttgaactgtgctcagtaccaggattgcgagcattttgagtttataaattgccatagtctgaatctgtttggtgaaaatggtgataccaacgaaaaacagcctgcagtgcaatcgaactcttcacagcatcacctcgagcaacagaacgaacagaaaggcccacctcggtttgtggaaatcacctctgatgataaaaatgaagcagtaccgaattctctcagcaatgcattggacttcctggactgtcacttgacttgtgattcaccaatgttggaagatgaagatgaagacgaggatatagaagacgaagacgatgaagagggacgcggaaaaggacgcggggatgaagagtatacaaagaaggaactggacaagatattaaataacgatagtacttcgaatttaaacttgggtgctatttcacaacagcacttgcaggcattggataatggtgctacctcgagcaacaacaacagcaagcttatccacagtgagaatttcaaaattgctaatcccactctcaatactccactcctcaacgaggagaatggcaatcttactgtaggtgtggaccatctacagaatggccttccagaccctctcagtatcaatatgaaaaatgaacaggctcatcaacttgaagatgagatgaacagattcttgacacccagcagtactaattctcagaatttgagtgtaaaacgtgaatcacctaagagcataaacccttctgctgttaacgttatggacattagcgtcaaacacaacaataaccgtgatctcctaggtttgaaaccagaactgaagagcgaggaattgcacgatttaaaacaacaatgtatcgatatggaggacaacgacgatgataaggatacctcggtagatgaccagttatttgaaaatctctgttcccaatgtgttgtcaattacgagttaatggaaaccccacattttcatcataattctcactctcatattataaacacaccaacagatatgaaggtattgaaggatttgtctagcatatccacattgtatgaactgctaggaaagcacgaacacacccacgataatctaaatgaaaataatcctcaacatcatgatcatgtgtcaatgaatctattgcattgtaccttgaacggctacaacgaatacaatcatactgagaatcaacatatccaattaaaacaatctcacgatcatgaatgcgatcacgatcacgatcacgatgattctcatcaacaccctgaccaaaacatggatgaagataaagaagaagatgaaggaaagaatcatcattatcaccatggctgtgggcaaacccaagaccaagaatatgctcaacttcctcttcattcacatcgaataacttctgatttaaatactgatttaattgcgaatactatcaacttcaactggtcattcaatacaaataacgagcctatctattgtcaatgggatgactgtctacagccttacgacaacctgctagacttacaaactcacgttttaaaagatcatgtcgcaatagatgactcaaaagttttgtcgtgtaagtggactgaatgtgacttcaacacagcagatccatgtacaatggttaaccacgtcaatggaaaacacggtataaatttcgatgtgaaggttcttgacaacaagactatggccaaacaagttaccgctcacaaacaacttcatgaagaaccacaatcttgtatttgtaaatgggcaggatgtaacaaggaatttgattccgcgaagtccttgaatgaacacatagaaaatttccatgttccaagtgggctgagctcatacaagtgcgaatgggagggatgtaacaaagtatttgttcagaaacaaaagctaattcgtcatttgaaggtacattccaaatacaagccgtttaggtgtgcagaatgtggtaaatgtttcaacacacaggacattctcacgcaacatctacgtgttcactcaggagaaagacctttcaagtgtcatctatgtcccaagagctactcaacttcatcatcattaagaattcatatccgaacgcatacgggagaaaaacctttaagttgtccaatttgcaataagaggttcaatgaatcgagtaacttggctaaacatattagaacacataaacgagaaaactgccgaaacagcaaaagggtataaggaaagaaaagaactggacactttcattctccaaatcatatgtcttttatcggcgttctttaatctttcacttctcatagaaatcattctcttaataattagatgaacttacgatattcatcgatttatctattctattcaactacaaagcatcatcaagcttagattaactggtcacatatataatgcatcatccacaagacagttaatcacataagttatttcatatcactggaacgctaatctttggtttatgaaatggtattgtattgtgcagagttctttgctctcaacacaaaagaacgatcaaatagaagaaccaataccgtaccaatacgtaagataattacagtgacacaaattaacaatactttatcatatatttttagtacttaaaagatttatttttaaaagaatcgcatcagtttatccacaacatgtaataaaaaaacaaatccaaatcattaacatctgtaacatcaaatgcgactaaaagaaatggaccatactattagaagtagcaaatttctctctccagaattacttgggagaagaagtatactgtcaataccctgttttgttgattccagaggatgaacgattaccaaatcaaacccataatttgagaactacatggaataaaatcgttaattccattaagcagattgttgccccataacttttctgtattcagcaagatcttctctgtatttattctggtattgttccttagtggaggcatccaaagatttccatttagaacttgccagtttcaaaatctcaatttgggacaaccctggattttcagttctcaattgaggactcttctccttcaagaacgaaccgaacgaagtagcgggcttctttggtggcaaggtcttggcataagcttcatatgcagcgctgtacttttcccggagaggtttcaaagcatcaacatatttctgtttctcactttctgatagtgacctccactgtttccctgcaatcttcatagcgccagggttggaaacattgtgtgatgcgcaaatatgatcgtgcacttggctgaaatagtaagagaatgcagttggtggtctctttggcttgactgctgcttcaagagcaattggggaaactgacaaaaagcgtttaaatatcatagttgaatagttagtcgattccttagtagaatactttgttatacttttgaagggaagtaatagaatgagtagataatatatttaagcgtttgacttgtacaagaaacttggcatgggtttgtattatagcggatgattgcttgtttttaattgtttgtttttgttttggaagggtaaaaaaaaggtctcataagagggggggcgggtagcgctcgagaagatttctgatttataagtcacgtgtatgtccgattaagggtgaaatggacttgggttatcaaaattaggttacaatgccattcaaattattgagatttgaactgaaatgcaatgatcatggagaaagcgttagacggatagcaaccgggtgatttttgtcgaccaagtacttgctaatatcgtggtataaagatctgtgatggcaattgtggaatgttttatagtgatcgtttgattgcgctgcggataatattttgagtagagagcctttagattgattcccttaaaacgtcgtgtaataccgtaatgtcattggtagtttactcccaagatagagatctagttcctggagaaggtcagattgtggtttacaaccaggcgtattttgagtatttacaggctgaggatggttatgctgggtttgaggatggtgctagaagacgaaattctagaatacccgaagacatctttgtacaagggtactaccagcggttcttcaaacaggtcggagttcttggtaacggatcccgtgcagttgtatataaggtgaagcacatgcttttagagaacgaactaggaacgtttgcattgaagaaaatatgcattggagatgacatgcattggttgtatcgttgtttgaaagaagtaaaactcttaaatagattgacagaagagagttcgcatttgataacttataaccacgtttggttagaacgttgtcccgtagagtcattgattttgactcaaaatgatggatcctcagtaaatatggatatcccaactactatgccatacatgttcatcttacaacagttttgcagaggtggtaatttagaagatacgattcagtatcaggttttcaatagaatctccggcaatgaaagtcgattagaaagaaggaagaagcttttgaaccacaagaaatcacgaattggactcactactcgtcagatcgtttctattgccaatgacatagctacggggttaaaacaacttcattctctaagaattatacacagagacttaaagcccagtaattgtctattattggaggagtttgaccgtagtgatacagataaatttcctaaatgtgtcattggtgattttggtgaatctcaattgtacggtcaattgagagatgccaccggctccactggtacagtggagttcgttgcccccgaactcaccaaaggagcccagttcagtttcaaatcagacatatatgctttcggaatgatcctttattttgtgatcatgggccaattacctttcaattccaaagatatgtcagcgataaaacatgaaattaatgaactttcattcagtcctgaagccatgtccaaactacacgactcactagatctagctcccatagatccatcattatacaaccttgtatgtgaaatgttaaatcatacaccgtcactcagacctgactcatcacaaattgaatatcaactaaatatcatcatgaaaagtataaacaaaagcatcaatcaagaaccagagatccgaccttgttacttcaggtttgctaccctttatgccctactaatagcactcacgctcaccacattgaaccattcccattggaactggtggaaatactgcgttttattcattactggtttatgtttcaatcatggtcaggatgcgggtaaccttgatttacttacagtattaattgcgtcaaccatcatatcaatcatatcgatgtatgcttaagaaattgtttcatacacacatacataacatttataaatatttcacttatatcatcaattgaaacccatttatcgtttcatcaagtgtagtgcggaaaccctgtttgcaactagctggtactggttgtcaaatactcttattaaacagcggaatttggacaacataatgaagaaggcaagaaagagactattccataaagatgattcccctgtagcaccgcctttgaacatcgacgctttattaaagaatgtacactcattggaactgaattatcaagggtttcaacctagcgagaagaaagctctattgaggactatatctgccctttgcaaagaggttatcgaaaatgcgatgtgccacggattagacggatgcattaaactagaagacctaaacctgctgtttaggttttatgttgacttagagaaggagttcaaactggactttaacaaagatataaagaagatgattttagaaggtttagctaaatttgagaacgactttgttttaaattccaatgagaaagtgataaatgtcgcattaaagagactatgtgccatttgggcacgattctattctcgggtatatcctgactgtatgatttgtcttatacagatccctgcagatatcgaacagctcttgttaatatgcttccgtgatgctattgtcttgccgtactataagaacttcatgaatgcggatgaaggaatatcgatgagtttttctaagtatatacagaacgaagaggaaaacggcgtgaaacaacagcacaaacttatattaattcaatgtttcggtgtactcagctcgataaaaggtaaagacatgaatcaaaggttgattgaagatttgttgagtggagtaagacggagtatagaagttctatagaaatcacgtcacattttcaattaagaacttaaaaacgatatagaatatttactccatacggcaccatggtctaccggtgccaatttgatgtttgcatagagaaggttcgagaattatacccaaaaatgctgcaattaatgttcctaatgaatctgaaattgaaacggatccaagaacaaattccctttcatttggatcgacatctttcaatatattcatgaaacagttcacgtaagaagaacctccaattaaaccttcataaaaaatcaacaccatgatccaagaaatcgaatcagtccagtagtaataagattgtgatagtgttataagaagattgatcaattgcagcactgaaaagaggtacaggttcttcactggcaacttatggccccaggttcttgaaataaacacccccagttgataaagggtaccataagtcacataaatatctctgtatttaacgaaaggtgtagtatctattgggaatagaagcgttggcgcgactccctgattgatcaaatactcgaagaggtaaactgttgataatggaatcatatatggaatcacaagtttcgaaagcctcttcactatatccacccacccatttgatttaagcaattcgataggcccatcggatgagtcaataggcatatccaggctttgataaacttgcgatgatactattgaatcgttgattttgtagtataacaagaaaatcaatggcaaagcagcgtatagcaggagagatagctgaatgtttagtctaaagacagtcgttaaaagtaaatacgaaaatgaaccgacgattccggctcccccggtgccactactccagccagtaagtgatttagaaccaaagaaatgggtcaattgtaagaacgtgatttctccgaatcctgaagacaacgaagccaagacaatacctggcaaacataaccataaagatcgcgttgacaccaaaataattcccaacattgacaataaaatcaagattggaattcttttatcataatgaatgctatgaacgaaaaacggtgccgatagtttaattaaaaaggaaggcattatatcaaacaataacacaattgatttcgggaggctgggcccaatgatatctgaagccgctgataaaataaccacatataatatattattgataagtccgaacaaccagaaatatgcaaatgttttcttgtctctatccaattccattgaatgttaatagacgtgactcaaccgaaaaaactatgaatcaatacactaaaaacttcattcaagagtacggaatctgctcttactttgaaaactcactagattatccagtactcttcaactaaaggcaatacatccttccccttacataccctaaatattgtctacacatgcatgtctcgaaaatgaaagctgtaaacttattttttttttaattctctggccccgtaataatttgaaggatcaacaaaacatttttttgtttgttacaaacagatctacaatgaactaactttacttgtcaacaacaataacaacaacaacaaataaacattagtttccaaacaagacaagtatcaggctcctctgatcgtcccaagatcggttagtttgtgattttatcgccaaaataaactgttcacactgtttcgcataatttccacttgggtagcaatgagtaaacacatcgaaatgccagatatcgacattggagaatggattgattctgtatctttcaagaaaaacggttacgagattgctttggtatgcactagcagaggtgtttacgagataacatcacctgctcgtcatgttagccgggaacagaaacacaaacacaaacaatgcaaaatccaaagcccaacccacaagcagttgttgagcctagatgtaagggaccctctatggacgttacagaaacgcaatgatgggtatgtagtcattagcaatggctatgaccgttaccaatacggccaagcagatgtaggtgatttaatggaaattactgctgaaatttcacctaaaacaggacaccaccctcacaacagcaatgaggttacatatcggtctagattttacacagtgatatgccaaaacgtatctgaaaagaatgagaccattgtaagagtcgtgcacaatgatgtggatgacagccatttggaccgcaaccgcgaaatgcctgctttagtactcaatgataccaagattttacaaattgttcctgcatcacagggaagatacttgctatttggaacaaaagttgctattgtgaaaatatccacctcttccaccgcaacacgaaattttgaggtttctctgcttgaagcgtcaatggctccacagttaccgcttgctgtcggtggtcatctagagcttgaaaatgtagtgattcaatgcccgtacgcctccacgtcacgtgaaaccaaggtccgaattccgttaccacattgtctctcataaagatatggaaaaaacacaaaggcaaggaattcctctattccgcacgcttgggaattccaaaatcagtcctaataataatagcttgcacttgttccggctcctgccatgtccatgacgcgaaatctgtaaaatatgttcaagtaggggacgcgtcaaaacagcattgtagttccgtgtccttgcaagattttagatctgtataactgtgaataaccgcagtgagcggtaccagcgactaaaaaacggatgtgaaaagccaatatcacaatgaaaacctaggaatgaggataaaattagtaagattaaaaatccgaatctaattttccgctccgttaattctgagtaatacccagtgccacgttcagttgcaccaattcaatgcacgtcttgttgacgcagccaataatcagaaaaaaggcaaaaaatatacttgaagaaaattggccaaattgttttttcttttcactatgctcagacggaacacgaaagttgccctgcatgtaccctttgggaaactttttatttttttcttattcccgaaaacggaaaccacggaaacggcgtagagaattgaggcaagacagccaaatagggaaaaagacttgataagaaaagcatgaaatactaagaaagttccgcacacaagcaaatggcaaaggcatcttctaaactccatgtgtatgcgaaagctacggataagctatacgtacaggatatctggttaattactattttctgttctgatttttcccctttttagccaggtctcccatttctcgtccgcattgtctaatttttcagttttatatttttcgttcattgtccaaatctaatgcaaggtaccgtgaggggcgagaaaaaaaggcaattaacaaacatcaaagctgggttgtgcttgcctgttgatatcttgtaataatgaaatagctgtgggaaaattgtaccaaaaatagctcctagatctaatggacaatgtataacgatttggcgacttttagaaagagagtctgggatgatggatggagagggaggtggacgattgatatgacagaaaggatgaaaatgcttagagccattagtctactgaatcttctgatcttaatagagtattacacagttttgctggttaatgaataataaagaccaaaaaaaaaggtcgcaagaacaacaatggtacgtagagatctggtggtacctttatttcatgccaaactaactaggctcctcataatccgtttccggtcgccagtagcattggcattggcattgcaatttccagtaatatcgccgtggacagcttttgcatgtggatgctgtaaacggaccttttcaaatctcagtatcctctcgtgctacatgcgaatctggggcaatatgctagttttcatttttcaatcatttttttttttcatttcccttttaaaaatggtcccattaattggcgtttccccatagaaaccggtgcagacgggaacttattgttccttttgccaccaaatatctgatttcacttactaagaaatcagacaatatttgggttgtacatgcctttcaggaactcaaaagaaatgcaatgctaatgagtttaagttgccttcgcgttctttctactgtcaaccttattgtttgttattgttggaattctttttcaaagaatggattgaatattgaaaaaaaaaaaaaatgctgcactctatttctactgcatgcttttcactgtatttggatgctatatgttttgtttttacatacaaaccaccataagataccatcgaactaggatgaaaagaatgcagtttcatgacatgaactatttgaattcttactgggtgctcgtggttttgcaaagtcttcactcccattagcaaaaagaaaatcgttagtaataacacgatttcaatgctgataactcaaatagggaatagagtagaacgggatctatactcgtcaaacgattgagttatgtcgtatatggaaagatgaccaaattatgcgttaccacgttcagatacggctagacctttagtatggttggttgctatgcggctggccctttattctctttcttcggatgagattactggccatattggaaaaagacatcccgtcgttacaccttttcttatctgctactccaattctaagaaaggggtttcgccactgcatcgatgcgtatctcgagggtttatcacacacacctttttgctagaatctcattgctcattgcttattcatggtgttttattttttgctttaattatgtgatggattataatcgaataatgttcttgatatcctgaaatatataaaagcactgccttttccgcgactttaccattccctatttgactttggttatttgttggcctagccttcgcatatttctgttgatatagtttagaaaagtaagctacgtgactaataagaactagccattgccccaatgaaactctcttctttcgctttaattcaatctgctacattgggtttcttggctaccgccaacgctcaaattttttcaaacacctcttctgttgaaccatcttcaactccaacttctccagtcactggtcttgatgttgctgatatcaacattctaaacggctggactggttctaaggactcttacgaccgttacgccccattcatcttcacaattgacatcgacgccgctgaaaccggttcagtttggtttgctccacctgcagaattcggtggtttcccagaatccattgaattcgactacggtactattaccaacgacggtaacaacttcactgttgaatttacctccgttccagacagcggtgctgctaccatcgaattcgttggttctttgactgctgacggtatcgctggtattccaagcccagatgtcgtcacatttacttctgactcttcttccggttctttctctgacaacattaacttccaagctttaccagaaactgcctcatcaaacgttggtttgattggtggtgacttgtactactccatcaacgttcctgttgcagtcttcgacggtagcttatctgtagcttcctcttctgaagatggttactctttcgacgcaagttactctgctgtctacttcgtcggtactgatgcattcaacaatggtactttgaccggtgctgatggtgtcaatgaatctgaggaatcctctgtcctagtttctttcgaaggttccatcccagatggtcacgttgctgtcagagtcgtctacaaggccatcatctctggttccgccgaaagttactctaacaccgctgacttgtctctaccaagcttgccaggtgctctatctaagagagacaccactatcactttcacttccaccatctatgttactggtcctttggctggtaccgttgaatcttcttcctcttctgtttcttctgatgacaccgactcttctagcgaaacctctgccactgaaacatctggcgaaccatctgccactgaaacatctggtactgaatcaggctcatctgaaccaaccacttctgttgctaccgccaccgttactgacttgtctaccactgtcatcaccacttgcccaacttgtaccggttctcacaagactactgacgtctacgtttccactgttactgctactgtcagtggtattgtcactgaatacactacctactgtccaatcagtaccgtttctaaggttaagagtcacgaaggtaccgtcgaaacttgtaccgttaacattcacgaagtcaccagcggtgtttacactgttaagaccgaatacattccaatttccaagggtactaccgttactgacctgtctaccactctagtcaccgtttgcccaacttgttctgaaaagaccgctactggtaccactgccccagttgccccaggtactactgagaccggttccccagctgcctcaggtactactgagaccggttccccagctgccccaagtactactgagaccggtgccaccgccgctccaggtgctactggtaccactgccccagttgccccaggtactactgagaccggttccccagctgcctcaggtactactgagaccggttccccagctgccccaagtactactgagaccggtgccaccgccgctccaggtgctactgaaaccactactgttgaaggtgaaactggtgttacaacgattaagagtgtcactgttgttactggtgctactggtgctactggtgttactaccgctgttggtactactggtgctccaggtgcagaaggtgttaccactgccgctggtactgaagctggtaagccatccagcagtatcacaactatcagagtttccactcaatccggtgtttccacttatgaaggtgctgctgccaacgtgcaggccgggttggtaaccatcttgatggctatcgctgctttcgtcttataaattgatgaattgatttcatcaatttattaaaatcgtaacgactaatgttccaactatagttttggaacctcttcttcacaatcataacagttttaaataccttaccccccatactgttattttcgaccttcttttgttcgttcgttcgttctgagctttattttcacttcttaagttcaagcttactttggtacgcctttgagatcaacttttaaaattcgtagttgatgaattttcaacgtaacattatacaattaatttaataatccatatatataactgtcctatgcacaggctaaataattctgcacttaatggattctttattttcgttcttaaactagaaaaactgtatttttacagcaccaagtaatgaacacttgacaatcagaaacgccgcttgttttactagcgagtttattctatctgatcaacgtatataaaaaacaaaagcataaataattgcaatcgagagattactatccgatattccgtttacacacttttcataagtagtctttcaataatcttaatctttcgacagattcttctaaatattggttatctttgcaaaccgcaaatcttagcaagttttctgcagccttttcatgttctttaatgtagaattctgtcggtggaatcgcgacaacacccagttcattaactagccagtaagaaagcttgaaatcctttgccctctcatttaattcccttgggaatggatattcgtcaggtatctgaaccttgctgaaatccacacagacgaagtaagtaccgtctggtttagtatatggtaatcccaattcgtcaaaaacgcgtgtaaggatggcaaacttttccttatattcctctctcatgttttcgaagtatccattgtgcaacccaatatcaatagaatgtgcacatgcttcttggaatggagaaggcgaactgaagcaaattcttgtatgggcctttgatacgtagcttagtagttccgcatttcttgaaacgacccaaccaattctccaaccggtagcagcgaagctcttacctgcgctaccaacagaaagtgtcaagtcaccaatttccttggaaatagttgcgatacgagtaaattcgtccccgaaatacaaatgttcatagacttcatcactaatgatataaatattgttcttgacacaaatatcacccaattgtgtcaattcttcacgggtgaagactttcccaattgggttatgaggagtgttcaaaataatacattttgtcctctcattgatagttttgtttaagatatcaaaatcaattttccattcggcaccgatggtaaccctttcacttagttccttaggagctaccaatggcacataacgaactttaccacctggaatttcgatatttgagatgtactgatcgaagaagggttcaaacacaatgacttcatcacctgggtttagcaagccaaccaaagaagcgagtataccctcattggcaccggtagtaatagtaacattactctcgttcaaagtttcattgtaaatcggagagtagaagtcggtcaatgacttcaataaagatggcctaccacgggttggcgaatactgattgttaagtgggacgttcaaagcggagacagcttgttcaattgcaaattttggtggagaatatgaaaagaaaccttgacctaaattcaaaatcgatctgccttgattcttttcgttcttcgaagccgcttgagctgcttcattagtcaatgtccaaacatcctttggaacattgcccataaaatacttgttcgcacgaatgccagtcttcccttgctgtgtcatattggatacacttctaatgccgaatcttcgcatatacaaaagacaaaaagaattagctctgcttgatttaattcagggatcccaaattccttctgagagcctttccaataagaatatacatatatatacaattgaacttctttcttatctaattttgataaatcaaagagattagatgtttatacatcaattaagtaaagggcagccctgacaatgtatatatatacatgtaaaatatcaccaaacagcaaaatgcaaacactaaaaatcagattccccccaatggcgacaggtggtccagatagcagccaatccatcaatattacctcgctttcaaatcgatcacgaatgattggaaaaccggtgcgatataaacctgaatacctgcaacactgtgtctcttgtcatatcctgggttcccttctaggttcttgctcatcagtcacgtgaatcatatttcttttgtctagacgccacagttttctgtgttttcccgggtaatattctatttcagtcacatgacttttaatttatcatcctgtcttctttcttttcaccgatgactaccgaattatcctctcaccccgatttaaagcgatgatatttcattcttcatacatatatcatctttacaatatatatctgtctgcgtaaatggcattcatctatattgataatttcttttagacttcgtttgcagatcatctctcaacaaggtaccgctataacatacaacctacatgctttccagtataagaaaacaaagtgtaagattagtcggtctaagaccagcctttgtcaggttgaatcaaattagaacatttcaagaaagaagagcaggtccaccaccattaccaaaggaagaccaggaagagtttgaaaggctgcagaagctagcgtcttctcaagaagctattgattcttataatgcacagtttgaatcggatcatactatggaatcggtgaaatcgccaatcttgaagaacgatattggtgggttttctccagaatttatgaagactataccagagttcgaaggcgaaaagaatcctaaaacaggagaaattggtggaccaaagcaggatccattaaggcatggtgattattctttcaacggaagagtcaccgatttttgagcgccattcacacgttaaaacaaaattcggttagtagcatattcacataatgaaatgatataaaaagtagcacataatatagtaaggtatatgccagttttaaaactaaaaacgaaaaaaaaaagatatgtagatggtgattgctattataccgctagatcttcaatggatgcgcttaactcattcatacaagaattgatgacctttttgtcgttcagtaacatttgttgtagggaactaaattctagctcggaaaagaaatcgtctcctttagtagttgatctaagctgtgtgtccaaaaactctagttcttcgcgaagtttgtttgtcagatgtacatagttattgaactttaatacctggtttttgatacttttgaaccacactagttcggcctcgctgatactgcttgttcttaatttctcgttattttctatactggagaatgtctcttttaacttgtcaagtcgtttttccaacgtcttggacttttcctcatacctggaatatctttcttggaggtctcccaagtttccgttaagtttatttctcaacatttcgatctcgttggtttttcttaattggcgatggagttcagccacttcttcgttggatttgttgaacattctaaataaaatcatctgtcccaacttgacgcgcttcatggtttccttgtaaagttcagaaaccacttccaattgacgttcattggaattgttcttcaaagggagaggagccaaagagtccggtatgcctgaaatgaatccattggcttctgttttatacttcgtcaaaagcatatccaattcctttccagacgttggcaacgatggtttatatgtatatttcacttcatcggttctgtttatgggtttctgtgtggtgctcttgtcgttactctcgatgaccttgaaggaattgccgttgtaaagaatatcaccagacaaggtagataaaacaccgaggaaagttcctgaaactgttcttattttattttcaaacttaacatcatcaatgatagagaagtcatgaagccttatgcactgtgccaatggttccaaccatggcatttccatgatagtcgtggagctatcaccagtaaatactaatttaggttccgaggagtttagtagttggcattgaccttttgcattgaacattgttattacactaaggttattgaatgtagtattggagcgtaaactccaactcatgacaatttcagaatcggagaacaacacaacgtttgttccatctataaattgaagattcaaaaggcccaaacgttctccaaccggtatgattgtcaagcctgtgacctctttcgcattcaaagctgtcggaaatttttttataatgaacgggccctgtggtacagagttcctgattgctttgctcgtgaatgtgtctataccatcattttttttatagttgtcgaaaaattgaatttgtttcaatagatcatgctttaaggtgaggtaatcggattccacatcaggatctgaacctgatatcagctttagctgtttatcgaggctattgtataaagacaatgatttgtgcaacatgtaatccgctaaagaaccatttttcgtccttgatgtgacatttgatgtatcattactgcgtagggaaaaattctttggtagacacggatggatagcatatatgtcacagtaattgaaggagctcagcagataaagtgtcaaaccggttggatcaaatgcaatgtcacaaactgattccacatggtctgataacccaaatgatctcgatttacgattgaaaacagtgatagattcgggttctaggtcttcaagatcataaattcgaattgtactatcatcatgcaaaataacgaaagataacccataagtagccagaggatgccataatagtttttttatccctagactggtattgaaatgctttcttaatctagattgctcattcacttccatgacatagagctcgctgttcgcatgaaatgctacaaggccccccgacggactgatgaccatttgttctggaacgaatggaagctccacattataactcctgtattgcgtttcgtggtctgattgcactcttaagatgttgtcctgccataaataaatagtgttggaattgttgcagacaagacggtcggaagggttcagagacacttcctggaagattgccttcaaatcttctgtattgaagagtaacatcccactatattggttcaatatccggcagttaaagttatggaagagaaggtaccacagttagatcgccagttgatctgtgttacgtgtatttcaagaagcgtgagagtagttcatcgtcgatatattttgaatattttgaactttaatagtaaaaaaaaaaaaatacctatagcagatccagtattgcagaaaaggaagtgtacgaaagatatcaaaaagttatgttagatatgtgtctttatgtcatttttatatgtatatatatttacaggcgtgaatcatactgtgggtccgttaaatctttgctaagaagttattttgtttgatgttggcacggttggctatccttaattgtttttttcttagcttgattggatcagctgctagtttttcagcttggacgttggcatcaagcactgtccagagccattcagggtattcgctgtcttctaatgccacgggttccttaccggatttcttgatttgtaagttcaatggagtgccagctggacatgatgacacgatcttggcagcttggccagatgcctcgcttttcacttggttaaatagcacgcgagtcactctcaacatttctctctttatataatatgaaaaataaccgatttgttatggtgggtatgtggttgccgataccaattcgaacctcaacaataagttttggcaagtttgtcctgccttgcggctatcaaagttcatgatcatttacagtccaatttgaatttctatggtacaaaatgttgattttatcgaaatttttcattcaaaaactaagaattcacaaaacgccaagcagggtaatggcgaaatccatgacgacattatagagggaccaggccgcgtagtagcatagtttcgggctaaacacggaccaaatgaataggtggtaccttagtgcaatgcacgctatcattagacatgttccggtgatatagtaatgctgcaagcgtagtgtcttctgtttgtagctttgaggaattagtgagagagcccagtagatggatggtgcgtagttagacaagaacattaatacaccaacaacgtatatgttatagttgctactaacaccattgtatgcattagttagattgacagttgcaatggagttcgtaccaccaaattggaaaaaagtgaggttttgtagacataatgagaaaattggtgtgatgtccggtgtgacgctagtcagtatttcaaatattagaaacaatgggatatttgcagatgaagtttggagcaacaagacgaattttataacactcagtagtttgtttaacatattggtgcttttattcaaggcgtatttcatgaaaagaaggattataatagatacaccacatatttggaagaaaatccgagcgataggcactaaacattgtgaaatatctgattctgtagcattttcattagctagatacatggcgcatgatctaagtgcgaatgtgtatagaccgcttgggactttatccccgttaacaatagcaaagcatattttgtaagttatcgaggacaaggccaaaaaggacacggagagtaatgataccattttctctgattcgtctttgtttctcaaaaatgggaaacccacggacaagaaagtcactacatttaaccaccataggactgatgtatgtgattttaaaagagtgtgtagaacattgtcgtatatatatttttggccactattgttccaaccacgaatcagccttaatccagatagcacaaccagttttttcccgttcgatatttgcatcagtagaagtacggatatcgtgatccaccaccatatttgatgttcttcttcaataaaactacttgcaaacatgcttattcctaatagcaccgaagtaccaacatgttcaatatattcctgacttagttggaaattccataccgtgactatgagcgttccaattatcatgagagtagtaccataagttaagaaagtgtaattgtaatttgtagcagccattgctaaagaagattgaatttccctcatctcctccaacagagttcctgcacttttcttctcgagttgtgcttcatagcctggtttcaacttagttaactgtagataattatcttgcactttaatcgctgctaacttggatggaagcaattgcaggagctcatcaattataacacccatactattcttaggaattggaagattgaaaagcatactcaacgttggaacaatatcgatttgttctacttctttcaagtacttgtagtctggatgagcatcttcaacgggcacattagaggattgctgaatatcagagctttgatacttttttaaccttttagacaagaacgctagggcagcacttgtttcaccagaagaagaccctccgtggtttcccaaatcattcatgccatgatctccaagaacaaccatcagagtatccccgtcaattttttcatatatttgtttgatcacagaatccatttcccgatgcttcgatggcatgaaatgggacttagaaccacctttgtgaccaatatgatcgagacctaaataatgcaaaatcagtacgtcccaattcttttgatgctccatttgataaggcacatgtctggtaacgttaaagtccacttcttcgaaatcactgacaaagaaggagttagtaccgtcatactctgagaagaactctaacggaaacaattttaaccatgtgtcatcgccaaagaaattcatcttgtagtggtgcgtgtgaaattgcttcagtagcgagtcttgttcttttaggtttgatgatgtatcatcttcagcaacatttagaatagcatccaagaaattcggagcagatcccgtcgttatccccttcaatctcggcagagttacagttggcggatttgaataagctgtgtagccccaggcctcgcctgagttcaatagtccatgtaaaaattcgaagtctgaagaatctttctggaacaagaaatcactccgcagagcatcaattacaaccaacactagtttcttgaacacgggtttagaggccagttgtacctccggattcacaatgaatttagaatcattcttcaaaacaaccttttgcggaaagaatcctccacagaagagaaatacagcaaccaattgcaaagtggccagcacatagtataattttctacccatgatggattcagctgtgtgattcaattcaccttgtcactactaaccagtttgttagaacaactcaacgctattcccatccaacgctgaaatgtattgatgtttacgttacgtctttagagatttttcatgttgagagagatgaaagaaaggtaattgaaggaattttagaagaacagtaacaaaacaaacaagtgaatgaataggtgtccgatgtagtgcggaataatcatatttcatatatacatagcaataataaaaggaaatgaccgaatatttaatacggagtatagaggtagatttgttaaggataatgcaatgatctatatatctaaatactaaagtaaaaccgtaaacccaagtgcatatgcaaaaatgttcttcatcacagtgaatctactgtaacaattggtctctgtaatgaggttggttattaacgaacttggcagctcttttatcgtctcttttcttgtctttgacttctgtttgccaagtagtcttttgtacttgttgttgttgtctatcgaaaatggtagcgaagtgtctggtgtctgcagcaacgatagtaccttggccctcactaagttcacgctcaggtttaagattttgtctgtaataccgttgtaaggttctgtgaccaaccttcacaccagtaggtagatgtaattcgacaccgtcgttgtatagtatatgttcaggtaattcttcttcttcttcatcatcttcctttttatcattctcaatatcaccgtcgtcatcttcatcaacatccacccactgggattcatcctcgttgacggctttatctaactcttcataggtactcgaaaaatcataaaactctgatatttccaacttttcagcttccgtttcgtatggaatacggcaatgctttttcgatagcatatgagctctgaccgcttctaaggacctaccttggtaagaacagcagaaacacatattacccaaaccaatcttttccgaaaagtatttgaaaagaccacttttatcaactaaatatttctgttctggaatatagaaaccatggtctctgaacatatgatccaaattttcttcaaaagttttatacttcttaccggtaaatagacactcagtttctggaatttcaactctgttatgaagcttttcagccattaacttctcagcaagttgatcgggggtcatttcttcttctggaatctcttctgctttggatttggcaacttcgtccttctgttctgcttctacttgcacctcaggatcatctgatgctttattaacaggagtactatcttgcatgttcttcaacatagactccttagcgagctgcaatagttgctgcttcttggctagtaacttctccttttctaacctacgcatctccttcttcgtcatctgtttaactttatccttcttatgcttgttctcttcttcttccttctctacacgagcattagcaaccttttcactaaaagtagcttcatctatggatggcaaaccagcgactcttctcttcaaattgtatctgtgccagtccgacttcatgtgctctctttggccaaccgcagtgtcaaacacaacaccgcaagtgttacaagtatatccagccatatctttgtcctttaccttagttcgtgtaggtttatttctcccgctccgtcgatactaaacaaagcaaactaatatttaataatgttgctccaagaagtacaaaaataacaaggctgttaattactgtttctcatcactagccacctgaacctattcgatgagatgagatgagatgagcttctataaaattttcaaacattcacgcactaaaaaaaaaagaaagattccggcgatgactatgggtaaactgtccccaataggacgccaatgatgtaaataaagactactcgattcgatccactggctttgttctatgtgagtcgtttgggaatatatttcatacttagatatctagctctctcagggtatatagtaacacactacttagtatctttattccttttccattgatagatttggaatttgcaaatcaacatgtagataggcacgatggtaatgttcaacaaggcacctaggatccatgaaaacacgaacatgaattggctggtgctatgtttgtttaaaccttgatcgcacgccatcaatagccaaccaatagaatctgtggtaatatcatcaagcccccatttcaatgacgagatgatcttgtcacgacattgggcagcggtcactggattactgggtccctcaatttcttttgtaattgcaggtttagttatattttctagatcaaagccctcactttggaaattacctgggtacacacaggtgattcttgtacttgaatgttcctgtctcaagattgcaaccaaagatcttatactctgtttcaaaggagcatactgagcgtatccaatgaaaggaaagaacgctacctcggaggaaaagaacagaagatggggcacatcatgctttaaagaaacatgggccaaattcacggcggtggaataatttgttgtgataccgttttgtaattcttccggtgtcaaatctaagaacagttttgggattgaccccccagcacacatgtacacctgtgatggaaccaattcactcttgaccagtagcttgaacatcaatgctactttgtcgtatgatgacgtatcacagctgtgatatatcaattttgtttcatttctattggtatcgttgacatatcggtccaaagaaacaccatcaacgccaattctctcacaagcctttaccagcttgctctgagacctggacacaatgataaccttattagtattcgaacctggtccatcatcgtcttgcacaaaccgtttcgcaaaagattcgccaagcccctgtgacccaccactaatcaaaatcacctggccgttacaattgaatcctttcattactataaataattattgaaatatactgattcacaaaaaatcgatttgtatatacagggcggggaagtggacaaaatgatagacgaaggaagctggatccactagacttctacgatcctacctctttgataatcctctttgaaaacttaattcattatagatttccttctaaagctggtgaaaaaaaatcatgttgaaacctttgcgtaaaaagaggtagagtaaactaagtgcagattatttttgagcacgacggattttctcgagctcgtactccttcttcaactgttctagttctttttcgtcaataggaggaataggaacatctgcaaaatcactatctttgttcaacatcttgtatgtatatgtgtatatcgtaccagtaacaccaagaagtataactaatcccattaggttcttcttgaagaatggctgtctggcacggatcattgccggagtcatcttccatgtcttgtggtcttggtatggactaggttctaacatttctttactttatctgcctgtggtatgctggtggtctgctggggttgtctcaggctcttcacagatcaaatgctgtagtttccctgattctcttacgttttatatctttaagattttcaacttttgaaaagtttcttagtgaaaaagagctaaagagccaatttatttctcatttcgaagtgatgaagagaatggacaatggaagtttcgcaggtaaaacgacatgcctggtaagctttctactctaataaagtacatttttatataccgcagatactgctataattggctatttgcttgaagtgaggaaaacagatctttttagagttatatcggttcagtttccccttctcatcgcatattttaccagtacttagttcttttttctttaacttttaagaaaaaaattttcgaatttaatgatttagatactatgcaagtagcgaagctacattaatttaggtagaagttagtcactgttgttaggctattttttactccgagagatccaactaatttaaatatgactagaggtctagccaggcatttgtccagaaccaagccacatagggatgcgttgatcagaaatatggcaacacagttgttgcaacatggcacaatttcgtcaacaacaccgaaattaaaggaaacacaacgttacgtcgaaagaatcattaccattgccaagaacggtatacagaatggtaacccttcgagcagcgtacctgaattacaaagtagactttatttatccggtgacaattcgaaacttttgaaaaaactgttcgatgaaattgctccaaggtacaccgccagaaacggtgggtacactcgtgtgatgaagttggagccaagacttggcgatagagctcctcaagcgatcttggaacttgtggatgctccagtacagaacgaagacggtcaactattgaaagggaatttgaaactatggttgttgaccaaaacttgtatgcaacaaatagaagatgctggacaactagctccaaaaacggtgcaaaacttaaagaaaatggtgcacaacaagactctagaccaattgctacatgaaatcggtgttatcagaaaatatattcttgaatcacaacaacagaacagtaccactgaagtatcagaattgccagagtttgacgaaacattacaacaacaatttttagctgctgtgaaggatcaaatacaaaatcacacagcagaaaagaagcaacctgatggatatgttttcagagaaagacctacccaaggttaaatagttttccttctaaaattcatccgattttgtttatgtactgttaaacagtgtgtaacctataaaacctgtaaatatcacgtgactttgataagttgactggcagaggcttcggattactttcacaggtaaccaaggcaaaccaggaaaagatgtcctttggagaaaacaagattgcttaacttttttacaaaccacatagttctttatagcttcaattaatcacgaatagcttctccagtttgaaaaccgctctgatcttctgaccactagcttttattcatatcaattgatatcttgggaactcttacaagaaacttcaccggctgaatctttcacctagcgttaaatgtcgcaatttattcgtcgcttgcacgttcctccattggcaaataaaggtttcaccgatgcaatcggtagtaccccattgatcaagatacagagactatccaaagaattgggaagaaatatctatggtaagtccgaactacagaaccccggtggatctgtgaaggaccgtgctgccctgtatttgattgaagatgcagaaaagaaagggttgatagatccaagcagacctgtcactgtggtcgaaggtagtgcaggaaacactgctattggattagctcatatctgtaaagcaaaaggttacaacgctgtcttctatatgcctgatacccaatctgaagcaaagatcaacttattgaaatggcttggtgcagaagtgtatcctgttcctgtttgccccatcacagatcctttaaactttaataatagagctagagaccacgccaaaagattggataacgcagtatggacagatcaatttgacaatcaatcgaactggaaagcccattatcacaccacggctcctgaaattctacaacaaatagaagaagcaggcatgatgttggatgcctttacttgttctaccggtactggtggtacatataccggtgttgccaaatttctgaaagaagccacgaatggcaactgtaaattagtcgtagctgatcctcctggatccgtcatttactcttatatcaaaacccgtgaattgaaaagggaaggtgggtccttcaccgaaggtattggccagggaagaatcactgaaaatatgagacaaagtgtcgatataactgatgatgctgtgtttattccagatgaagaatcaattatcatgcttttcagactattggatgaagaaggtcttttcgttggtggtaccacagcactaaacgttgtcgctgctgctaaagttgcacaaacactacctgaaggcagcaatgtggctaccattctatgtgactcgggtcataaatatgctgacagggtcttctctaagtcatggctacaaagtaaaaagctttatgatgttttgccagaccacttgaaaaaatatgcctcattagaatgaaacctttagatcgaagagactctcttagtattctatgttggtttgaataaaagttaaatagttgaggattaatcactatcaaagcaataattaacatttatatatagttactattcaattgagaaatgcaacgacaaatcatattccaatcccaagtgacatccggatcatgggattcatagagctcttgccattttaacaattcatagacaaacattaaactgggctgaatgataatattcaatcttcttactctaacataaagataagctttcaataatccacagtccaaccttttcatacattcggcaatgcaaaccgttgcactacgagaaacaccgaccatacaatgcacaaacactgcttcatttttccgataacattgatcgataaaatcaagcaccatatccaattgatgaagcataggatccattccgttatcaccaaggttgtcaatatgacacactctaaatccatcttgttcagtaatattgatgaccgatgctgcttgagaattagcggtaggtaaaacattaaacgaattgctccgttttctctccatatttcttgctggtaatgtaatctcttcattaacagtattagatcttggtctacaccacgaaacggattctccaacggagatgatatttcttattcctaattcttttaacatttcagggcattgtgcatgtttaagggaccccagatataaatggggaaggatccttgacggtaaaggacctttgcatttcaagaacggtgaatcagttggtggttttatgaagaatattttactgaaagtatccgcatctatagtcaatggtagctttggatcggtcgtttcatttctcatgggagaatactgtcttaatagtgtctctagatgtgataaaacctgaatgtcaatcaagaacaggaagaatggcctgtcatattttttatgcaaatcgaatatcacttcatctaaggatttgtcgagtttaaagatcaaatatgcaacgagtaggaatgatgtctctgtgtatccatctggcgagaagactaatttgttttgcgggtagaattctaacaaatggcaaacgtttaaaattgtttgaatggaatctaagtttaaatttcccagtccgatagagccggaactaggaaaactcaaccagacgggagtatccacaggatgtttgattaactctgaaattttctccaaagacggcagttgagcgttttcaaagcaattgataaacaaacgccaatcattagtctttgaaggaatattgaataaggcattgtcattcaaatcagtggcatttacaacagaatttgatggttcatagtatgtagtcggagtttctagcgtgtcattttccgtaaatttaccaattttccaaatttcggcatcagttgaattcccacaccatatattttccactttggtcgcgctgctcatcttgctcacctccaatctctcggtatagtacatatcacgatcccagtttttgaacgtagctagatcaaaatctgaacagaggccttttttggtttgcaaagatgacaatagtattggcggagttccccaaagtttatcctggatctccccacgtagaattttgaattggcattccggtaacttggccaatcttcgggcccattttaaaacattaattagacgatcgcaacaacaggagtctgttacgcaatacacgatacaatgtttagttaggtgaaactgcaaagatggttgtaaatcgaatcgacggaacgtacgaggctgcttccatttctgataattatttctcacgcaattgttgtcgctattgtaaacggagtgaaatgggtccgtttttaataagggcatcgcttcaaacaacgaacaatcctcaatcaactgcaaaacatcttcctctgacacaccttctagcgatttgagtagatctttcactactgtatctattgttgtttctttgcctattggcaacaagatatcgaatacttctaaagaggatttcaaaaggccagaattctcgatatacttattatctcttatgttggatcttatcacagagaccacaaacctatcaaagtctgaatgatacggttcatccacataccgctgaggtaaaacttcctgagtatctccatgtaaccaggggaacattaccgatgcatctggtaacggacttttccattgattattcaaaagctgccaaacttcttcagaaaagattgtatctttccctcttttaaatggcatttgggataagctctcgctctgtcgcttcgaagtaatctccggtatctgatcaacttgcatcctgtagatagatctctccaattccaacaaaacgtagagagcgctccaaatacacgttgccctactagctctatcttagaagatacttttttcctatgacctggcgttcaggtaaatagtgcacaccgatctcttcgaataggctgcaatggcaccttatcagagactattaccagctcacgacggtagcctattccgtttgttctccagccaacattgtgagttcttgtcaaaactaggattgacaaggaatttctgagattagggtggggttattggtactgacagaaagtaaagaaggaaaataaccgatattgtatgtggtgttagggtgtgttgtcaatgatattccattaacctatgttctaccaccgttttggagtcgtgaccccattatcatctgcccggtagagtgtactattctctggttgacttaatgagccggaataccctctttggtaaatgttttgctcatggacacattatctgctttgaaaagtcattatgcacataaaacacgaaacactttgaaaaaggctacaatctaagcttcaaaagcgatgtgctggataagaagaaggagacaatagcagccataaacgatacaataaccacaatttacttaagatggatgaatataaaagtaaactaccgagaattcctatttctaagtgcaagaagatcgccaggacagatccagagtacattttgaccagtcaagcggcttttgcagctaccgcattcaccacagaattgttcatccagatgctagcagaggagacctgttctctagctcagatacacaagcaaaccaaaactttgagattgaactatgaagacctatctaccgctatccgcaacctggataagtttcaattcttgtcagatgtcgttccgcaaactgagaatctggcctctctggtgagagaaaacaaagtcagatacactattgtaaatcctagcccggaaatagatatagaaagtgaagatgaagttgatgaagctaatgaacctgaagttggtgaacctgaagttgatgaagccgaagttgaagctgaagttgaagctgaagcagctgaacccgaaactcatacccttgatgaacctcgaccagaatcatcgtcctgaacatcggttctcgaaatttctctactccccaaaaccatgtttctgaccccgaaaaatgcactccgagttgcgcccaaaaaattctggaaaacatatatatacaatcagagcaagaccccaatattatatatatgaatacgtgaatgtccttgagttagaatgaaatggtcgcatcagtatagatgtggttattttgttccaagactatcaggatttttgaagactattgaaatatagttactatagttggttcatcggaggatcaataatacctaagatcaaataaaaaaggaacaagagcgagattataatgggtttatatcgtggatccgacgataaagattacaagggagaaaacgaatctgtcgcctttccaggcgaggtttgggaaggattgctatccagtggtgtagtgcatgatgtgttacagggtcttggattccctggtggatgggcatggaatatcgataaattggtcgatgatgtgaataacggaatcactaccaggacaaagactcccagcgtagaacaattttcgaaatgtaacgagttgaagggtgtttctgtgtgggatacaagaggcctttggagatgtcttttcccccagtcggtagttcagaatggtggtctctcgagagaggccgttgaagctgacaaagaccataagctaggtcttttcttccctgagtattctgggtttttgtcgtggagagctcacatgatggcattggcgaagcagaagaggaaagaggaaagagagatatattccttgtctactccagaagacgtcatgctgaaccaagtcgactcgttgggaaagaatgtggtaggaacttcgtcttattcgacgtacaaggcaacaccagagggtaaagaaagaatcaaagaagagaaaacttactatgaggacggtacagtcctggtgaaaactaagaagaagatttatccccacgatggggaaccaagagtggaatcttctgaaaagttgctaaataccgatgaatcgtcctaaaaaagtactgtaaatagaacaatttgaagtaatacattgtatgcacacatttatatttcttatgtaatgccagaattcatgtgaccatgaccacctgcaatgctctgcctcaagaacgccagaattaccttcctcgaggtggtataaattccgttatagctctcctttactggttcggtgacaattttcctttttgagaaaatactggccggcattatcaatgcaggctctttttcactatacgaaccttggttatggtttagggaacctgtagtggttgtaataatgattggggtggagcggagtactttctgactgtattactatcgttgccgttgcattagataaggatacaccacatcgataagatgcatcatgaaatttcattcggcttggagcaatatataaatggaggcgatgatggtatgacatattcttactcgttgaagcaaacaagtgcgtgaagtactctttgcgatctgtataaggaaagatctatcctcaccaaggtcaaagcaaacctattcctctaaacatgttaaaaggtggtgaaactgctcaaagctcttcagtctggttgaaaagtgcactggtggcctctgttttactacttaccggattcaagatcttctctcaattggaaacttcgaatgacgtcgttaccaatgtgcaggagtttattccctattgtagagataattatgagccgttggcaccaaaagttagttcaaaattcttgaacaagatagacaaaatcttgaacaacaaagagttcaaagatgacgtcgcagcaaagctctctggtgcagtccaaattccaacagtgattggtgatgttttccctaatcctaaggacgacctggaattttattctgagttcttcaagctacacgattacttggagaaaaccttccctcttgttcacaagcatttcaagaaggaaaaggtcaacgaagtcggattgttgtacacctgggagggttctgattcatcgctaaagcctgtgttatttatggctcatcaggatgaggttttagttaatccagaaactgttggcgattggaaacatcctccattttcaggctactacgatggagaaagtgtttggggccgtggttcagcagattgtaagactaccttgattggtgaattagtggcaatggaagagttgttgagagacggcttccaacctcagcgaacaatcatcttgctgttcggttttgatgaagaaagtggtggtgagattggtgctcgtactttgtctcagttcgtggaagaaagatatggtactgatagcatattcaccattatggatgaaggggccggtgttgttgaagtggagtcaggactatatgcagctgttccaattactcaggaaagaggatttggtaacattgaaatcacaatttcaggtccaggcggacattcctctgtaccaccaaagcatacgaatgttggtattttaagtgaactagtatacacgctggaaaataactcatttgattacgtgattgaagacacgcatccgtttttatcctattaccaatgtgttgctgagttttctaataagatagatcctggcttccgtcacataattaagaaagcagccacttcatacaaatacagactggaatttgtaaaagcattggaagtatttgatcctttatcagctttaacgttcaaaaccaccgagtctattgacatgttccattcaggtgtcaaggtaaatgcactaccagaaactggttctctggagatcaactaccgtattggcatgcactcaaacgcaaaagaggtgttggaaagaactgctggcattaccaataaaattgctcaaaaccatggatacaacttgaccattgacggtgatcgggtcatttattccgatcctcagaatgtgggtactttgaacttgaaaatgtacacctacaaagatccttctccaagatctccaagttatcaagataacgataaagtctgggatcttttcgcaggaactatcagggattactttgaaaatcgtgtgttatcaaaagatgagccatccaagttattcattactacaggcaccatgactgcaaacactgatactagacatctatggaatctgacttctcatatctatagattccaaggtgcgatattccctattgaattgttcgacattgttcattccgtgaatgaacactcaccagttgctaatgtcctacaacttgcaggctttatctaccagtatgtactaaatgctgatggtgctgatgttggtttctaataactgtagaaattaaataacaaacaatataaacatgaactaactatccttagaatatgttaaaccgtaatattcaaaattgtagttatcctatgcagaactgtcgctctggtggattggttactgtctggtctccattctatatctgtcgtatattcgggtaacattgttgtccgggtgacattattttcttgtttgattttttacttttcaacaatcaaacaaaacctgtcaaagcatagagaatataagcttggaagagtagaactacctgtgaaatacagcctagatagagggggtaacctttgttttcctgttgtatcagagggcagaacttctgggtgggagataaatttatagagaatgtcaaggcaggagcttatcgcaaaaattcgttatgaaaacgagctaccagctccgcttttaccaccgaagttaatcaaataccaagcttcgcctgatgaagacgtaagttccagcaaacttttgacttcattgtacactaagaccaatgttacaccattaattgatttagaccatgatttggggatgcctctcgatcttttgacgattcccggtgtattaaaccaacaaaacgtaggtggattgtttgggtacgataatattaagttgaagcaagaagatagagtcttattgagagatccaggaatggataaagtggtacagagtgacttatcgaaggttaccttcttgagaagaactgaatatgtcattagcaccaacatgtcgaaggctgacaaggtgaaaagaactcgttctgcattgcaaaatgaagaaacattgactccagaacaagtcttggaaaaagtggaatctacattcaatcacagaactgacgaccttgaaaaattgcgtcatccaattaaaaagaaggtgaaagctgttaactcttggaaccttttaccagatactgtttcgatggatcaaggttactttactgtcaaatttgttggttccgctgctcttgatggtaaagaaaaggaaaaatacgacatgagcactgcgttactcagacccgttgaacttgaagaagacgaatggatcagtgcttactctacagaaaaagaaagttctaccaagctaagtgaaaacttggaacagcaaatagatgagatttctcacgacgactccatttacaaatttaaaaggttcagagatttcgacatgaaacaaattgaaccagaaactcaatcaagcgatttagctctaaggtatgataacgacaagcgtaccgtttactataaacctctgcgctctagattagagttgagaagaagaagagtcaacgatgtgataaggcctttagtcagagaacacaactgggatcaaattaacgtcagattaagagccccaactaccaaagaaactaaagtaagggacgctatcaggatgagatacgatccaattgatttcccagcgcttgatgacgatgaggaggaagaagaggctgaagataatgaggatagagactctcaaaatggagaggattctcaaaaccagggactcgcttctactgaaaatgtaaaaccgactgcatctgacgaggttaaagaagagtctgttcaatcagccactaatgaattagcctctcaaaaggatgaagatattaaaccggaatcacctgtatagtttacctctggaggtagaaatacggtgggccctggtcaaccttcttccaaaaaattggaatagaaaaccggttaatagctcatcccatcaggacatgtctactgcagtaccagatcaatgatccgtcaggttcttctcctgtcccaatcaataattgacgttaatatagacgtataggtatatatgtaattgtagcatactcatctccccagcgtaggaagcaaaaatgaaaaaaaaaaaaaaagatagtcatgatgaagataaagaaagagttctggtagtagggaacctaagttttgctcgaaacagaagtggcaatcagtacgctcttttgaactaaaccggcagtgcgtatcaattggaacaaaatggctttaaagatcaattctgctattgccgtgtgcggcggtaaattgttgaagttgtctcacttttcatcatgtacaggaacagacatggatgttaatttgtatttgccaaaacaatattacactagcattgacgactcaaaactgattcctagtgtcttgtatttatctggtttaacgtgtacacctcaaaatgcttcggagaaagctttctggcagattcaggctgataagttcggctttgcagttattttcccagacacatctccaagaggagacggtgtagctacagaccctgagggttcatgggatttcggtcttggtgctggcttctacgtcaatgctactgaacaaccatactcctctcattataaaatgtatgactatgttcacaaagaacttccggaagttctggctgaagaatttggttccaaagttgatttcttcaagaatatctcaattacgggacactccatgggcggtttcggtgccctatcgggatatttgaagaatatcaacagatataagtcttgttctgcctttgctccaatcgtgaaccctagtgctgttccttggggtcaaaaggcttttacggggtatttaggttcttccaataaagaagcttgggatggatacgacccaacaaaattgataaaacatgtcgagaatctcaatggaaataagattttaattcatgtgggctccaacgatccatttttagaaaagcacttgaggcctcatttgcttcaagaagcagccaagggtactttttgggaagggaaaattgaagtaaactttgaagatggtttcgatcattcttactacttcatatccacgtttgttcctcaacatgctgagttccatgctaagcatttgggtttgatttgaatgcaaaagaatggttttaccaacaatttgcctggattgattcaatttttctcaaatacattatacgttaacataattatgtaattatataattatgtataatcatgccatttaaaattcgatgaagtgtcaataatgccctgacggtatatctgtcctttgtaatcaatcctttattatgattgcacctgattgccaaccacccgccgtgattgcaacgcatgttccatctatgtcaacctttgtaggcctctggaccctaatgcttctcgctctttcaaaagttccagctccacttgaaacaatagattccggttttccaagcccgagacatccacacatttcgctttccaatccccatgtgtacatgtccccagtgtctgataacgcaattccatggtagtcaccaaaagataaagagatgattttcacatttggtgtgatttcaatcttggttaaagtgttatgagcaacttcgctgtctttaatttccacggtatagcatgtatcacttgtgaatattgctaatgtgttattagacgcctgaacctttaccatttttccctcaataggtaaatctatgtacttctctatctcatttgagtatagccatagcttttcaccctcatttgtaatgtaaaagacggcgttatcggatccgcacgcaaagtccactattttattggcgccattcacttctcctgtattgggaattactttgtaatgagcattagcaaatccatcaaaccctacagttgtatcccttgatttccacacgactaaccccactccatatataaaaatgcagttgcagttccaaccgcaacttatcttcaaaattggattggtacttctcattggtaaatcattgaatatcagctttactccgtggtttacctctctaccatcccaagaataaagatcatttttgtcatccaacgcaagaaaatgtgatctacctgaacttactgcgacgaacctgacactgtcgatcattgattcatcaaaatcttttggatctttcacattgaatattgactttggaagcatccgcctcacttgatcatttcctggtaaacatttcgagctaatatcactaagtttcataagatctgcatatatatcttcatgctgttgaaaagttcccgttaagtttgtcgtatggtgtggattttgaattcttattggatcaccaatggagcccatgactctgaaaggtccatgcactaatggaaaacttctttctaaagaacggatcgtttcatcgattggttgaaaatcgtgttctccagcaagtggaccaggtccattatgtccgccatggtatgtggcccctgttgaatatagctttcctgactgggtcaagatctggaaggaaaaaccacctcctgatatttgaacaattgatctgtcatattcacctaatatgtttgtttcttcctcagtatcgtcatcatcccagctattagctctaccagatattggtacagaataaagcatccaaggaacttcaacgggtttacaaactccgaatgtaattcttctatccagctgattcatggaatctgcagaaagtctactattagagctaattgtgtaaccaagtcttccgtgctttatgcatccccaagtgaatactgcgctccgatattttctgagattgtacaacttgtcccattcaatgcctgggtgagtattcaacaatatcgtttcgctgcaggtttgaaacctctttgaattcttcgagatgaaaggctcatcattcgtataagtattcccgaatgacttcctgaagagttcatgccatagaatagaagagttagagtaatctagcaacttgttgaagtatttattggtgagagatagattcttaatatcctttgaggttaaataaggtaatattgtctggacaatatccggaggcaagctttcttttatttcattggatgttggtgcttcagacttcattattagtagttgaatataaaatcctcagctttttggatacgctacggcgaactttcaatggtacgacccctgtgttctagtttacttatccatacttttatgattcaattcaagggagctcggagatatctgaatcttcttttgttacccggatacatgtggatgccaagagagatacataccaatcagttgaagagttatgtaaatttgacgaaggttaggctgtcagaactctgcgttggtatgttcaaatatattcattaagtgatgctgttcaatgcggattagtgtggatatatgtaattaaataatatcatgttacgtgcgaaaaaagcaaatgcaattgataagatagtgtggattcagagcctattgaatactctggtaagaatctctctcatcttataccagtttttcattcttaactgttcatttggtagatgtgctttatcatttgattggccacaaggtatttgtacgacaggggcgcccaaagtcttctcaaggtatctaatacttggaatggaacctccttctctcaccattaaaggttctgtgttccattctttgcctatttcctctcttataatttgataggcactattcgaaggatttcctaaccaaggttctgcttcatttaataccttgatagagagatgatttttggtcttcaatcttgaaaagcatgaatgcaagtagtcattcaatgactgtttgatgacattgagatcttgaccaggaaccaatcgaattgatatgtcaacagaggcagattgtggaatgactgtcggttcacatggtccactcaccttcatggtggtaactgatagtgatggtttggtccatttggcgattaaactatcgactgtgacagattcgtgtagctgagctctttccacaatttcgatcaattgtgccagttctttctcagacagaggctttatgttgtcgtcataatgtggaatcaaaattttcccaccatcatcttgtaatttagaaatgatgctgattaaatcggctgtaggttcacgatgaacaccaccatcaaacccagaatgtctatttggttcgtcactagtcacactgactgttaaattgaccatacctcttagcccataattcaaacagggaatgttgtcatctaaccaataagaattacttaaaatgacccaatcaatcttttctccgaatctatatctattgtctgcaagtgcttctttgaagcctgctgaaccattctcctcttgtccttcgatgataaaggtgatgtcatgatctagttcaccattttgcacaagttctgccaccgagtacatagcagctaataatggacccttgttatcagatacacctcttcccttcaaaaagccgttttcacaagtgagtttgaaaggatctgtgttccaataatccatatctgctgctaccacatcataatgtccgtaccatactattttcttccttttctctacatttctggagttaccagagaatgcagaatatacgatgggatttccttcattgtgaacaggaattaaatcacaatttcttgctcctagtttataaaatagctgctggaggtgagttgcacaacgacgaccttcaagtaagtgtcttgtatcagcttttctagaaacagtttgaaaatgaataagagtgctcaaattatgaagcatatggtcattatccaaattcgtagcagtccaagaattatgacggtccttggcagtagcttcatgactatggaatatcggatctatatcctcttggccattattgattaagtctgtgatattccaaaggatcaaggaaccgtcattaccacctgtgacgagccttgtatacggatttttggtacaacttttgcaaattatctcagagcttaaaatacttccttgatgcccttgccaatgataaacgtcatcctggaagaatttagtaacgccttttctttgagaggcgaaaatctgatcttgacaaactgccagtgaggtgatatcacttggatcatcgctctgtaaggtacttaccgattgattggtgttcaaatcccaaattttcaataaaccgtccgtgagtcctacgtagaggaaagggaattccaggaattgtgttaaaactggttcatcattatctaattcggtaaccaaacagattttgaccgattgatcatcggctggatctacatgcaatgaccataacttggaaacgccatctccaccaccagaaataatgtattgaacgtcaggtttcaagtccaggtatattggtagagtatctctgtgggactctaatttgacgatggaatatacaaatccattgtgcgcaaatggtaggatattggaagatggaacttgtaaggtctgacacgctgattcttcatcgtgtagtgacagggatgatattgtactgggtaaagtttcaaatgaatctgcaaggggttgtgttgattgttgctgaggtccctttgagtcaaaaaatttatcgaatcttagatgaggcaacatggtgtaatctttctttaagttgttttgcttgaaaacattggcaacatacaacaaggacgcattctgcgagccaaaaacaaccaagtctagttcatcaatatatgccaatgagaagatatcaccgatatccattaacgagtaaatagtaaccatctctttaacggctaaactgtagtcatgagtgttcccaccgactgaccaggctcgtactaatgaatcagctccaccactaaacaaatactcttcgtttttggactttgtcaaacacaaaacgctagatctcgtgttggttccatctaaagctcctagacggatggtatgaatcaaattgtaagtgcgtaaatcaatgcataaaattctagaatcctgagtaccagcaaacaaaagcttcttgcgtggaaatgtaacggtagacaatatacagaagtcatggctccatttatgtaactgcgatggagacatattcttctgattttcgaaatgtatcggtatggggggggggctttcttcagtacaaagatttctaataacagataagtgagtccctatgtttcagatgctctcagtacaacccaattctcaatttcaatggtatctgatgcagagaagtatacacgagatactaaatgccgataccctttatatatacacgggcatatactaccatcgtcaaagtttatgtgattcattggaaaaccttatgagatgagcgaaaatgccacaatttttctagtgtgagatatcacgtttttccatgaacaaacataaccagagaaacaatgaataggggtgaataaggagcaattgggactggagcattcagggcatcttttaattgtttgagtacatgctggtgttggcagtggatatttatcagaagaaaactgtatgatttaacgacttttttttttggatattacgtgctgtacttcaggacgatttctcaaattatgctaccttggccaccgacagaaggaggatgctcctcgtcagcgtaattgtatgatccggatcttcaatgcttgcaattaaaattgagctgtaaacccaatgactgtgttcttcataggttcaaatcttattcgcttcaagcatacaatagtttttatgtgaccattttaatgatactatcatgaggattataaaatttatataatttcattcaacttatacgtattttatcatactaatataggaatactgtttaatggtaaaactgtcaccttttaagtatcccactccagttattgtttgcagccagattcgaagctatttgacagtagaacggctttcacttgatagtatataatttttctttgtgaaattgaaactgacattaagcttacaatttgtaaaattgaattgaaatgtggaaaggaatctcaacaatatgagatatttaaaaggcataagatactatcctatcctgacaatccctggtgtactatcagacactcattgcatgctcgttagagcttatattaccgctagttctgttctttaaaaagtttcccacccgtacaccgcactaaattcgtttcttttagaccattttccatatcaaaaaattttcaaaggcagtataatccataaagctaaaatgaagctcatctcaccgcatcgcatcgcatcgcatcacttaataagagactgcgtatcactgcgtttagaattaagtttacaccttataataaacaggtgaaagaccaaccagaataacaatggaccataccataccaccaccagatgaagaggaattagttctttccaaattagtgttcggagacaatagtgacttttataatgaattgcagaatatcaatctggagctaagtagcgaagaagacgctactgagtacgtacagaatagtgactccgaagattcagagagcgacaatgaaattggaaaggttatggatgaccagctctttttcgttgatgatggtgaactaaatgtggatgatgaagatgcgatggacattgacgatgagaacgaacaagcaagtgggtctgactacagcaacgagtctgaggaaaatgaatctgatgcatgggttgattctgacgacgacagactacagataactgtaacagaaaataacagatcaaaaaagctaaggaagtcccacgtagaatctcaaattaatggacgagagtacttgcaaaggttgagatcacaatttgaaaagatatatccgaagccaaattggatagaagacgaggatgatagcgaacttgacaatgacagtgaaaatgaaagtggtgattatgacaacgttatagatggggacatcaatgctctaaccaagatcctagaacgtacctacaattatactacagcaaactcgaaacttctccccccacaaactctcgatataactaggctgaaggatgcaaatgcttcacatccatctcattcagccattcaatctttatccttccattccaccaaaccaatcctgttgactggtggctacgacagaacgttaagaatatatcatatcgatggtaaagctaatcatttgataacttcagtacatatcaagggcaccccagtccagacctgttctttctactcatcgcaagatggtaaggaacaaaaagtgtatacaggtggtagaagacgttatatgcatgcatgggatttatcaaataataacacctcagtagccaaaattgataagatttcaagattatatggccaccaggatacccaaagatcgtttgaaaagttcaaactagcccacttccaggacgccaacggagcccgccatggattgatttgcttacaaggtaataatggttgggttaatatcctccattcctccacaggtgtatggctacaaggctgtaagatcgagggtgccatctccgacttctgtattgattataaacctcaacagaacgggcacttccatactattcttattgctacaaatacatacggcgaagtgtgggaatttaatttgaatgaaaatggcaatacagtccgtaaatggaaggacgatggtggagttggaatcactaaaattcaagttggcggcggttcaacaatttcctcaccaaagaaacgcatcattccaaatagatggattgcaatcggttcagactctggcttcgtgaatgtatatgatagacaaagcgattcgcaaagaccggtgttcacattagaccaattgaccacatccatatcctcattagaattttcacctgatggtcaaatgttatgcatagcgagtagagctacaaaggacgccttgaggttagtacatctggcgacaggaactgttttctcaaattggccaactagcggtacgcccttaggtaaagttacaagcgtagcatttagtccgcaaggggaaatgcttgcagtaggaaatgaacagggcaaagtcagattgtggaggttaaatcactattgaaaaaacagaaccgaaatgcggagttcgccgcattagctatgaaaaccatagaatcatttttatgtatagacttcaacaatgaatatttaggaccacctgcatctataatatatatcaagcatattaataattctcttcttatgcctggctcttgcaagtccgcactaatcactaaacttacccggttcttgttttgtatggtaaaattttttcttagctttcagttctctctgttaacatgaaatcagaaagcgtcaaaattgtttgagttcaaagttcaatgaaggacacgacacacaggaaaggcaccttgacatcatctacaaactcatttataagtcaaaactttgaaattatcagactaataaactagcaatgaaacctacctccgctagattttttcaacaatctcaaataacacaactaacgagaccttggaagaaataccgtgatggtacgttattctatggtgcttctaaagtaggtaacaagcgtgtaccattgacgacgaaggatggtaacaagtctatgtacaagggtaccagatcttcaggtattggtagacatacacaatatggtggttataaaattaactggaacagggtgcgtacatataccgttccaaaggatttcaatacggatttgaaaccactattatctcataacttgccagaactaaaacatcaattctcagggtatcagaaaggttacacggatccaaagctttacttcgacaagttaaagaagtatgtgaaggaagggaaaatccaaagcgaagcaagcaatgtggaaagctatgttgaaagaggatgaaatataaatattaaataaaaacgggttccggagtttcaaaaattcacccattaatcatgtacataggatgttaaaaagtatagattccagaattgtcttctaacttaaaatatacatacgtatttatgtatgaataactgtaaaataaaatcattcgctactttatgatcagtattctacttccaacaacacagtcaatttcgcggctgccttaggaagaaatattgaggtaaacaataaaacatgtcggtactatgaattttcgatgaactgtacatttacatttatatattagtgattgtacacgagatttatatagtaaagtctgtttacagtttaagcagctctacctcctagcatttgagcgatagaactttgaccgcctgtttgttggaagtctacggtaacgacttctagaatggcaaatgcactgcaaactgcaacaacaataccggcacctttacccttcaagcctaatagttcaccaactgcgaccaagaccgccaaagtggctgcaccagtggcagacgctaccggaatgattctgataagttccttagaagcatctctgtgaccagccaatgcaacatcttgttccttgaattgcttggaaacatcacgagatgatgagccagagatttcttgccagtttgtggcgaaccacacaccagtgacaatcaagaaagccgagaatgtgaccacagtcaatggttgcttgaaaacagcaaagaacgaagttggtggggttaacaaggacaatggaaatcttgctaaataaaagaattcagtggactcataaccacccaaaactttgttgataatggaaccctcttggttaccaccaatcaactgaatgatgacgaagccaagtatatgaatgtagaacaaaatggagtaagaaaatagcaaagataggccaccagtgtacaataatctgatagggtaaacgttggacattcctcttgccttggtggatctgatagacaactctgttctgatgttttgtagataacagacggtaccaccaagaacgattactaacaaaccagaagtcaagtttggtagataatctctttggaaagcattgacaagtgcgcccaagaaagtcttatgcttagcacggaaaccttgtaacaagttgatgacagcaccccttggttctctatggccttcttgacccactggaatttgttgaacaccgaataaatcgtcaactaaaccagtagacagagaaatggcgataatagccatggcaccagaggcaaacccatgccccttgtcaataacttcgatcaacaaggtcacaaagaaaccggcgccgatcaattgactgttaatcaaaaatttagccattagagataaatcttcgccatagtaacctgatgcaatgaaaatgttagctaagatggcataactgccaatggaaacaattttgatcaacgtttggaacaattctctatcagttctttggttgaagttgactttgatcaatttgaaacctgccaacaattgcaagatcaatgcagttgcaattggtgggaaaataccaaactctaaaagagtgcgtggttcggcagcgaaaacaccacgcaagaagaagatagggtccttcacatcaacagattccttagtaatgcctgccagtgggaattggccaaataagtaaatcaatgcagtagtcaaagtaatgacaagcttatcatcaaatggtaaattgtcatatggaagttcaatttcgggaacaaaagccaagaatggctttgccaaatcaatcaaacggactgtaacaaaaaaataaatattaatttattttagaaatgttgttagtaactgttatagcatacgagaatagttccttgactaaaatgtaccttgcagtaccttcaaccgataatttcaggtaccgaaaaagagaatgaacctaaaggcaagttaatgggaaatattccagagtttaaccacatgtaacatacaacctgccatttggtggatagctgaaaataaaatgaaagattagagcccttggtagtctttcaatcagctataaatctgggtcccgaaagtgtacatttgttgaacttacagatatttgttcaattgcaatcgtttttaatctttccatgatatcgcctttcgaacaaacaatttttttcatactggtgctgccttttcaaggtactcagtcgtttgttacgaaactcacgtgatcaccctaatatcacgtgagttataggaggaaaggtatccagtggttatacagcaaatacgaaacgttgaacgaataacaactggttagcctagtaatgctgtaagtttttggttcaattgaactagtgaataggccataggatgtcctatataatccctgcttcctttcctgcctttttccctctgcaggaaatccaaataatctcttatatattattcacaccaaatagtcaatatcactttcaaacagttgaaattggtaagtattcattcaaagagacccatttgaaaatctcccaggctaatcagatcgaattataagcgatgtctaagcttttgaaattgactgggtttactacactaagcactttgctaggtgtttcctattactattacgtgattgacaggccactataccaacaaactgcgcttcataagaccaacgttcaggttgagaacatcattgacaacaaagcgcaattccaatatgagcatatgagccgggattcccaagctgttgtacaaaggccatttgctgaaactgttaaggacatttggaacaaagaagtacgcaatactgctgactggctatactcttggggaaaatgaggtatatctgtctggctccctacattcagagatgttgctctgatacaacattcattaaatactattaaataagatattcacgaacttaaaaataaagaaactttacgttattaggaactgtctctttgatttagaggcaccatcgatgttgttatttctgcttgtccgttagcatttgatcggagcttcaattcaaagtacaagaacttatgaaaaaaaaaacccgtttatatacacacataccagtgatgagatgagaagatggttgatccagggttgcaaataaattgacagtgttcttctctccgcaatatgactacccctgattcaaatattaactataaagatgctatagactactggacaagcattccagctactgtggatggtgtgctaggaggatacggtgaccagactccgttacctaacatggatgtgcatggttcaatgcatttcgttaggaaactaaaatcaagaatgattaccgagggtcctaaaaacagttgtgatatcggtgcagggatcggaagagttaccaagaactttttgagtaaaattagcgataaagtggatttggtagaacctgtagtgccatttgtggaacaagcacatgtggaattggatgcgttaaagaaagagggcaagattggtgagatatttgctattggtatgcaagactggaaccctgaagaagggaagtactggttgatatggtgtcaatggtgtgtcggccatctaccagacgaagaattgattcaattctttcaccgatgcaagaaaggtttgcagaaaaatggtaccatcgttgtgaaagagaacaatacagttggagatgatgatttcgatccagtagacagcagtgtcactagatccaatgagaagtttatgcagttgtttaaagaggccgggttgaaagtcattgcaacggaaagacaaagaggtttacctgacggcctctatcctgtacagatgtatgcattgaaaaccgtagtttgagacaactatttcaataaataggacatcagtaagagcatgtagtattctacataacaagttgctatactaattaaaaaagaagacgttcaagagacagagatttcagataggagcgaaagactaaattcgatgaatttttatcttcatataggaagttatccttatcagttgaactatgcactgaaggaaatgtatcatcattaagatatactctgtaacccaagacaaatggagagaaagttagacaagatttaacatgtcttgtcctgacactacgttgcaccatgctcctgcataaatcaaacaatggttatccatttttgaatacaacttggcacaggacaagcctcaaagagttgaataattcttccagctgacagtcgctgtatcgacctggctgacaaccttattagaaagagagagagaacgattatcctcttccaaaaagtagcgatgagatacgtatcttttcattttcgaaacattttttttttaagcttttcagaaacagcagaagaacagtaaattcaaactggttaaatagtaataagctggattacagtggtgttttagggcataatttaagaacgtcagtgaatgcaggctttttatggcatgagatgcgacaggtcgaagcactcccgtaatcctcgaccttaattgcaactgaaggagtggtctgtattatttgtcactggtaatcacgtgctaccatcactaaccacgaaagctggctttgtaaatggagaatgtctgtttggaacatgaagaccgatatcaaaactataaacacatacgtgaatcaaagtgatccattattgtttatgaagcaagaaagggatctctttgattgagatacatatcattcggtcaattatatagcaggtttcagtatcagcactcaattgccatattaggtttctgattttattttttttcggttcatcggaaaacgcaggagcgctaaatataaaccgtcgtttgttctttttattgattaatctaatttattttaattcagaggtgataggaactgcattgcttcatttattcaaatatgagtgttgacacttctgagtcagggacagatccaaaccttactggatgtgtagcggagccttctcaatcaaatgatttgcttcaaagagaagaagttaagaaagttttgtcttcagatatcgccatcaatgccctactatccaggttgaaaggttcccttttgacatgtgaggagttcaccaaattcatgagaaaaaagtacttgtatgaggaagagcatgcacaggaaatgtccaaaaccaccaagcatttcttccaagaaactgggaattctgggttatctcgatccatccatcaactcttggagtacgataacaaactatcgcaagttaagatatcgtacgttagggcattgcaaaaaatctatgatgaagtaacagcgttactgttaactgtaacgaagaccagaaaatccttaaaggagaaaagtaggagacttgaaaaggatgtttctgatgcgatccacactgccgaaaaagctaaatcaaggtacatctctttgtgtcaagattgggagaaattgagattaactgatcccactaaaacaaaattaacgttaaggggatcgaaaacaacgaaggaacaagaagaagatcttcagcgtaagatagatagcgccgatctggagtataaacagagagtagatcattccaattctttgagaaatacttttttgagtaaagaacgtccacagatcgtgtctgagttgaaagatttgatcttagaaatcgatacagcaatgtcaattcagttgcaaaaatacacaatttggacagaaaacatgattctaaacagcggggtttctgtaaacccagtagatggtaactcaaaatctatgagaagttctgcaacctcgatgaataacgaattggatctttacaacttcctaaacaaatacaacacatccaaatcgggatccatgataaataagaatttgattcctgttgaatacaaaaagcatccatcaatggcaaggtcatacacatctagcgcaatgggaacaagcagtaactttgggaaaatatctggcccctcgaattttgtcgtaaataactcaaaaaactcattgccaaaaagagtcatgtccactcaacatgagtccccattcaatagttcttcagcagctgccgctttgtcatccacagtatcaccttcagctaccacacacccgccaaattctgcttccagtggaccgtctcagagctctgtgaatggaaatagcataacatcaacatcttcaagaccattgaaatcaatggtcgatgttgtgccaccctcagaaacaaacaagaaagacttcccaactcttgacccacgcccaaatattcgccaaaccagtgttgcaccatccgttgccaccaccgaaactatgacaaggccaccatcaacagtacaaactattgggtcattaccgcctggtactgcaaaagatttcaagacatttgcagttcccctagagaatcttctggattacgatcaagatcttgtaccggctattgtccgccaatgtatctacgttattgacaaatacggtctaaacttggagggcatttatcgtaaatctgcaaacgttcttgatgtgtcacgactcaaaagtgaaattgataaggacccatccaacgtctttatgatcttaccaccgaagaactacactgactctgatatttatctggtaggttctttgttaaaaacattttttgctaatctccctgatactcttttaccaagagaaatgaccgaagaaattaaaacgtgtctatcgattgaagattcaactaccagaaaaaactatatgcacggtatcatctataaactacctgatggtcaatattggacgataagagcattgatattccatttgaaacgtattttggaacacgaaactaaaaacagaatgggtttaaaggcattgtgcattatttggggaccaaccataatttcacctaataatgaagatttgaatgatgtgaactaccaaataagtgcgatggagctcttgttcgatgtggcggatcaagcatttgaacctgagtaaatgtactaataaaaagaaatcatttaaatatcaaaactaaggtaaattctataataagtattgtacgttaccattttccgatgtatagtattcgccgcatctcccaagcgcgtctttgaattctccgcggctgatacccgggaaagcagaagcgacatattcaaaaagttttgtctttgtacactttcttctttgtttcaacgtcctgataatgcatgcacagacaatttcagtgaaccatctattatctgccttatcgttttccataatttttggcgatattttaggaagatggtacagtgtcaatttaccatcattaagagcttcctttttgggtttgtatttagtattcagataaaaacagtcctcagaatcctttttaaacatgttcatttgtaaaaacatttccatattgctgtcaatctgaggtatattgtgctttgtttctgtcaaagtgttttttatttgttcaagtgaaagacgagcactgttattaaataagtgaaatattgatgcttgaagtaggttaacgtgaagtatcactatttcagaagaaattccatgtctaaaggggcttttcaattccagaagatttagctgacactggagtgacattgttttgtgatcattcctatctaaaaccttgtagtactcccattgtttattcaccataccatttaatggttccggtagtatgagtcctgaaatttcggatgaatccaacgagtccgagatgttagattgtttaagaatgacaggagttatctttggagctctcttcattctcaatgattcaattagttcgtcgtttagctgctggagttcaagaatgtgaactgacttcaacagcccacagcaaagtagctgttggtcgaatctctcgtttgttttaatcagctgctcggaaccccccaatgactttagtaccgaccgtagaaaatattttctcttatatatgttccatagtaactcgtcttgttttgagtctggcggaaagatgtcgttcataaaaatgcagcatgatctaaccagatctttaatcccagaaaattgcccttcctcagaaaccttacacaaccatctgtcaactttttcaatattctttatgtctgcattaaaagtcaatgtaatcatattcttcattattgcctttcgattagaatcaaaagattcgcttgacatggaataggtggagatgaaggacgacaaatagtcttcgtcaagcattttacatataactcgtactacgaagttatcatattcctcacctcgccacgggtaataggcatatatcatatcccctagctcttctattattgttattatcgtcatttgatcatccatacatctatcgaagaaatcctcgaagtatttaaacttcaataaaagaatatccacagtattgatgcttaaattttgacataatatttgatattcggaacagtagtatatgatttgtttttgaagactgtcgactcttttgaagtggtcagaactataagtaaaggagttaattatgcgattagtggtttcttcaaaaagccccaacactgacgatttatcaattggaatatcgtacctgataatgttcttgaccaaactgaactgggatgttgtacgtgattctaacgcttcgactataaacgattcgatagtttgtcgtagttgcgagtgcaatcgatttgctattcttgagaaaaagactaacgttgcgtagccttctaatgatcggcaggagatattttccaaactatttggaaggttccggagaaaagccttggtgtaatattgcaaagagttcaccttgccctgtatctttttgtaagcatcttctaactcacataagtttgttaaccattctatattcgtgaaatcttcctcgtccacctgttcatttatcaatttgctaagaagtgaccagagatcttcaacaaacgtgtccttaaagacagcagcatattgacttgaattactggaagccttagcaagcctcggtactttacatctaatcaatttttgcaaagtgaaatatatcttttcatcgtgtttaaggtcatctcctgggatttgatattgtctaagcagcagttcgagctcagataacagagaatcgtacagaacttttgagcttttgattcgttcgggaaccaataacggcatgtcacattgactgtacgttgagggtggaacctttatgcgatacatactgtcccataacaattgaaatactaagtgttatatgatcctacgtacttgcccaatactatatcaaaaagacatacgagtcacgtgccaggtaaaggaagtacattgtgttggctacgtaactagcagccaatgacgtaacagtagaagttttggtatactgagctcatggtattgtgaaaatattattcaccagaagtttactgttaggtttgaatccaagattaagtgcaaatatgccatcttctttcctgatcaagagtccgtgcttgactaaggatgataaataatggctgaacattgcttggttgcgaacggaaagagcactaatcatttcatctagcgaccagcttagttttttattgaacaatgtatcaagaatgacagcatgacataaattgaagtttatggatatgttggttttttgaaaaattgtaggtttcatgatgactctatgtagatgcggttgatcataaaagtgtacattaataccatcacttgtaatccgtggttcgtgtttgttaacccattttcctggcagattaaaaggaagttttgccgaattttctgagtaaatattaggaaatatttttgctggtaagatgatatcgttcttcctattgtttctcgttatctttaatgacaaatgactgaacatcctgttaatattatttagtgtcccagcatcctgctgcattactatgtaaaagcgagcgaggggagcgtcaagttctagtttcttgccaactaaaatagatttgactagatctatggttagattatctcgaatgatttcttttataacgtattgctcaaaatacgaagcagaaaatggttgaaattgtcgagtgttcttcaagaatactcctattttcgttagccatcttctttctttttcagtcatgttgtatgcttttttacccaacacatctccaatgttggtagtgcctggaaaataagtaagaatgtgtttcaccatcagtctcatgaatttaatagtatttttagagtccaattcaaatgcgtattggcggctcattataggcttgcgctgttgaagaatgaaatccatcattcggatcaagaggcggtggtaattaggcccaacctcagtcaaatcttgtacccacttcgtagtaatttcgaggttagcagatagtatatccttttcggtcaaaacactttgtaaaccacatatattatagctgatacgctgagaattgagcggttgtgatgaaccgagtttctgtgagatcgaagctttgtagaaatcaacgtcagcaaatacagcaaaaaaaccggcacgagtcactgcaaaaacttcttcgggatatatttggagagtcacgttgtgcaaataattcatgaaggtataagcttccgcttcaaagtccttaatatctgactgtacttgcaattgggttttgaaggttaataccaagccctcgagaatagataagataaatcgtggattaacatcgttgttcttaggtagggatatcggatccaaaaaatgatgataatgtgaatcaaatcctaagtctgaaaataacttgcaaacctcataaaactggtcattcgatatggatcttgtctcaacctcaatttcaaaccctcttctaattagatcgttcaactcagaatataatttatatccaacaatggtgaccagccattgtacgagaagtgagtaatgtcgtatatttaacccgagtttgtgtagtgctcgctctaaaggtaagaaaagaggctgtattttccttagttgaagttttattgttaggatgtgttttgccaagctcccaatagtcaatggactttcaatagtgttagtcatatgctgcatttcattgtcaaagctttgtaagaaacctcttgtgacatcgagtaaacggttcttattgtcgtccaatccattagcatccgagtaccttagttggtcaatccatcgtgtaagtcgtttattcacatcttttaactcatcctctgatttattcactaaattaccgtaggtgaaccatgttagctcttttccgtttcgaatattcatgggaagttaatagttcatatctttcaggtgtcatacacagggctcaacgtataacaagaagctctattgctcctgccacttctttgttgaagtgcatcttgaatggaggtttgactattgaactatcttgtcttggccaaaaaactggaaattttggcgattttgcagaccttttctttgcaattcagtgtaagaaattgctaccttggtctggtattgatggtttcacaatcacctaagggtagtacacggcatgaatagtaatggtaacgatttgaaagaagagtctttagatcctgccaaatatttggcggaaacttttaagaaggagggtcatttagacagtttaaagaatgaaatactatctcaaaatgtagagggtgatattagcttggacgaattcataaagagccgagtaagggatttagttcgtgatagggtaaatgaagatgagtctttaattttcaagaacagaggtaccacgactgctcttcttgagggccaattatttaaagacggattcaagagtttaaacacgtcaaatatcgatgtggagaagcttctgagtgattcacttgacgatgcgacgacgagacaaaagataagaactatccttgaagccaaaactaatgatagttgattgaacagataaagtagcaaggctgctacatatatattttacttcgttaactaatgtaatataataggtcatcgcaacggcgactcttaaattttctaccggctctatcaacacttctatatttaaatctatcaccaagaattgtataggctaaagattcttcttcattgattggaatctcgaaatcgaaagttgttcctttcttcggtatgcttttcaattcatcgactaatccgcctttcgttatgattatgaatgtcttttgagcatcccatattacaataccatttttcccagttaatgacttgtttttggatttagataccttcaacttacacccgttataatcagccatagagagcttgatcaaagtttgctgagagttcaaaggtaatggatttccaactttgtgattatctgggatgttcaacaattctttcatgtatggacaccatatatcttcgaacatggaggagaaagtttcaaaattcggcagttgctccaataaatctttgtgtttctcttcaaggaccctttgtagctggtctctatctgaaatttttagtctcttggctaactttttgcaacttgcggatgcattattgcatttgtttatatattccttcaacaaaactcttgaattcttgttcactgccttgtaatttggatgttttaacccagcagatccacccatactacttgaatgaagaagttttgccttactcttctttctaagcttggtagacagacctccatcagttggcatcaagaacaacgtctgtgttaatctattctcattgataggtttccttggattatcaaaacatttagtgaataagcactcttctataaaaggttgaatacgatccattttggaagcccgtatatccgttcgcgaagtaacagctttaaaacgcaacacttaccgaatactggttgtacccagctttaaaaccggtaagattgttgtcccttcggcagaatgtttctttcaagtttatctcatctcaatttttcaagttttacccgatgagcttccgatatttgatttacttccatgcacaacgttgtgaagatgaagatataaatttcgttgggctgaacaatttgtgaggacctctatgggtgagaagcatccatgatcagtaaatgtacgcatcgagtagcgacaacgctattgagaagtggtatatccgttccaaaacgactatatactccagcaaataatcagattccatttgaactggatgaaacagatgaaaaatacaaagagctcaacaacatctatcgtgagctcttcactccaacagataaagctaacattcttactacaaaagatattgaatcaaacaagcgttctgaagttgatgaaataaatgaagagctaaattccttgtattctgtcggtgtactttcaccagcggagctggaagacgcggtaaaaagtaatggaaggttcgtcatcagaagtgtatctaccaacccatacttcaacctagctttagaggactatgtgtttcgtaatacgcctttaactgagaacaaaacgggaaatgaaagaatactgctttataccaatgataaatgtgtcgttgtcggtaagaatcaaaacccatggaaggaaacgtacatgagaaatatcgcatcaagagggtacaattttgtaagaagacgttcaggtggaggtgcagtagtgcatgatttaggaaatgttaactattcgtatttgacgtcgagagaaagtttccgcagagagttcttcaatcagcaacttgtacaatggttaagtaatgagaacattacgttgaacgatagaggcgatttgatctataaaggttataagataagtggtagtgctttcaaaatagctaaaggaaaagcttatcaccacggcacaatgctaatagattcagacctggctcaattcaaaggtttactaaaaccggatgtaattcctggggttgaatggacatgtaatagtgtcgaaagtgttagatctaaggttgataacattggcggaaaagcaatatcgtcaattgatgacttttgcaatttgattacggatcagttcagaaatctggttgatgactctgaaattcctatgttttattgtgatgaatcaagttctttactcgagatcacagagatctccgaaaacttacggagcaaagaatggaaatttatgtcaggcccaaggtttgaggtaatttgtaatgacgttacaataaaggtcgagaagggtgtaattattgaatctgactggcctgaattagttgggatgccattttacaaattttatgacgaagtaagggaagatgacaaaatattcaaacatttactgtaaataattatttatactatattaatgtgataaagcagggataaattcacacgcaggataaacaattagtttatttgtttgcattttgttacctctggatgttgaggtagagcaaatgcaaaatcttccacgtagagaatgcctttacgatctaggatgtataatgtgtgaccatcaacactgaatctcattgatgcggcttctctcattctgtaagcattagaaacaacatctaccgttaatattcttctcttctcgttatccatcattgtcggggcaaatagtatatttacggtaccgttcctgtctaagaaagcaatagaatcgtttcttggcgagatctcacatttatgaatcttagatcccaattcatccaatcgaaggagcatggttggttgcgcgacactttgaacaccatttatggattcgatttttgtgtttattacaattggaggggcgttgaatgctactgaggtgacgcacattagattgggattacctggaaatagtttagtatcagtgataccttcagattctaaagaagtgtctagggagcgtaaagatttcatgacaagtctaggttcgttgattttcctcaatgatatcaccaaaaatcttgactctaatgcagttgaacatgataaatacttcccatctgaagaaaattgtaaggtatgaattggatcgcgatatggcaatgtgatagttatcggttgaggaaactgccaactctgcgatgattgatcaaactcaaatctgtggaatagtaataatgcctgttcggaaccggttgttctgtctctgcctgttattccacacgaaactatggaagttatggggtttatgtcaatcgaacggattgggaacgatgagcagtatgtatatattggttccccacctctactcaagttgaaaacacggaatatacctcgtgtaccagccacaactaataatctattactcagtttgcagtatatgtgttcccattgtgaaagtgctgtcgctgcactgttatcttttgttttctttcttgttgtcctcatcgtggcagcgtcccaagactcgttgtaaatgggctgtaaaacagtcgcattctgtgggaacgatagtgattcaaaattaggaccaaactccccgttagtgttgccgcaaaataacaattcaggttccttgttcttcgagccagaatttgtggatggtatagagaacacctcccacttgtttggcgttatcagagcaaacttagtacagtctggcgagatagaattattgatgaataatttcgatttcgttcgtagaaatttagaatgtgtgttgaactgcgatcgttttctatacattggaaaacactttgcaaaataatactctttctcttcgttgaattcagaggcaatcgtagcagtattaatagggaataaaggtgtctcaaccatagatgaattgttgtcttgaattggtatcgtttttgagttcgagatgttatccaaggatcctgtttcgactgctattggctcctccgcggaggctttaaaattctgcacatcattaacatctttcaacgcaccgttcttcacaggtgaatcttgctcatcctctgtcgccactttacttgccacttgaagaaacaacgataaaagcgaatgcgatttatctgaatgacgtcgactcctttcagtcgactgtgtcaaagtgggatcttccagtatatcttcatttggaggtttattattttggtaaaatcgcaattggtcataaagatgtctcagtgggccaaccggtccaacaccagtaacagaagctgtatggcaaactggacaagtcgcagacaatgaagtctgaatttctttcgacaattgctcagacataatacagccacatgactgaacataagcatcgtcaatgtatcgatatttgactgaaatcttattcccagatcgcagtatctcactaggtaggaagagattttgttccaaatcctttaatatctgttcaatggacatttgtcaaaaacagatgtgtaaacttttacaataaatgaccagcactattttaataaggttgcctaaccagcccaacaactgcaaaagctgttttgttcttatgagaccaatgtaaaatggacccttgataatgaagcaaaaaatttgcaccaagtgatagaatagacctgtagtcacctcttttaactgtagattggctcttccaaagtaaaagaaacacgctcttccaaagttaacaacctgttcacttcgactgggttgatcttttttctcttctcttatctctatccatccattgtgcagctatatgatatcaatcttcactgcgtaaccgttggttcgacctttaaaaactgaaatgtttcgtttcgatttttttttcaagttctgtccaaaataagacttctgttcgaaccctggcttaccagcttttcttcattttcgtttttcctttagtaacgtttctaaagttccaggaatgcgagataactttccatacagaaaagtttcagaacgacagattcaacagatacagaagaaacttatgtgcgtttgaaaagatggggtgggaatgatgatctcattatcggtagcgtaccataagtatacagaattattataaaagcagaggtaattgtatgagtgatgaagcttattcctttcgtcttaatttcactttaaagattgatgaacattcgaaatacatcggtgataattcgaataattaataactaatagatcaactgccgtcgttaaccgcatttactttattagtatttttgagatgcaatttccccttctgatgcagatcggtttagtttgcttacaaattttcaattgcgtcgaatcgtttcccgtatcttctcaaacacactcacttagttttgacaccataagaagagtatttaatggaattgattcccttctgagtgaaattgggaaaaacgtaacaattttggaaaaccaattagccaagagtatcacctttgattcaactactttacccgagaaggagataagtagcgaaaccaatttcaatgagttgcaagaagctctttgcgaattccaagttgttcttgacaattgtatacgttttctcccgcacgaatatcagagggtgaacaatagtaaggcacatatttctcgtgtggtggccggtttagaatctatggatgctatttattacaggacgcataagatggttgccaactacatcgcgtttcaaactacgagacttgatgaattgagcaaagttatgtggaaatgctccgttgaaaattctaacacgaaaaatggttgcaataacatggctttgaaacaggtacaattgcttgaaaacgttgaattgactatgaagttaactaactcgtaccttgatattattaaggactccaaatttttgactgaaatcaagagtcaacaacctcaaaacgataattttcatgatcctaccgacattataagattactcgaagaagagtcgttggaagatttatcttgtgtgactttaatatttaaattgttattacttttcggcgctactagttttgcaacgcccttgatttgtttctggactgggtacttgaaaaatggaagcagaatatgtgagaaatgggcagtaaatatcacattcaaggagttttacatcatcatggaactagtaagaagaataaaggcatgagtagttccaggaattacttcatataatggatccttccaatcacctgtccgaaattttttctatttttacttacataggcgtaattgttattaacgtaaggaaaacattctttccaatcccgaccgttattaatgcatttacgttcgaaggctttttgctccttctagaaaaaagtttaaaaccttaatacttgaaagaggaacacacaaaaaaaaacaatggccaaacacctgcgcttagtatggaaaagatgggcttgttactcgtgccgctagtccacaattttgtgagacttcaatcatcagtaacctgtacttttaaccggttgcctaaaagctcacagaagacaaaatgaaatattatgtaatgcactatgttcccaaaaaggtatatcttttcgtacttgtgaaaacttagcattcagtaagctcgaatatttccaagataaaaacaaaaaatcgatcacaaaagaattttagaatcacaagttatcagtccattcacactatatatatagttatccccccatgaggtaagtggcccggcaattgtattatctttttttttttttcgtttattccgattcgaatgctagcagggtccaaatcgcactcacacaatatgtaaaccgaaccagagagacttgcatatctacttatatagatgcatacataatcatacccctctcctatacccctctctctttcttacatcattaacacgcatagtcttgtcaaatcaactttatctcgaatttcacaaggtttgcctgcgttgctgtggattttccttggctttcattcctgtgtgtccgtttctggtcgtggttcctcttttgatagataaaaaacaggcgaaaatcagtgggagtcggaaaaatataaagctgtatactggccgacgcacccaattgaacaaatacagtattatttttctgctgtaagaagagctgaaactacataaaatacctgggttcgtgagtattatcccaaaacttggccgttgacagctcgagaatttttaggaagttcctcggttcaactttatcttagcggtagctttcttttttttttcgcttttgatttttttggacttttctgactgttaaaagaaaatccaataacgatattcttagttttagggaaacagatcaccgcaaacagcagaagacagagtattcaaatccaacaaaacctaataataactagctgttatagcgtgatccgatattctggtcgaaggcagtgagagtaaccgttctggtgaatttttttgcttctgcttttacagttttcaacctttttcaatctcattttttcactcttcatcatcaggtagaatactaagagacaaagcttctactgttattagcaaaggttgagagaaaacagcgtgagctagtgaagtatttgatacttttagttggttcgattatactattatgaggtgtgttttggcttgtagtaggtgtaggcaacagaagataagatgcattcatgatggtaagcctccatgtacgtattgtctgcataaaggatgcggtgatgagtgtgttttgacctatcctccactgaagactaataagagtaaggtcaacaagaggaaggctaacaaacccctgggtaataacagaaatggtgatatgtcaggagttgccgttgcagctgcggagacacctgtctctgcagcagtagcaccaccaccaccaccaccaccaacagtgacaacgaataatttaatcccaaatggagagctgccgcataatcagcaagggtactctcaggaacgccgtcctgatgctgttttaactaatcgaaatttgaacgttgtccctcctcctccgatggatgctattttttcaccgggtgtgataccgactatcaataacgaaatgttacagtaccagtctctcaagaacaacgtgcgcgctccactattctcatctattcaaagtctggtaagttctactccaaagagccatattcttacagctattaaaagagtagagattagtttccctgagtgtcttttcttccatataccaacctatgaaaataggttagaagaagtaaaccatattcttatcggtgcgctgttggctgtttgctcttattccagtccattcaaagtccctgatttgaaatcagagttcagttcggaggataaatggttaggagtcaattcgtttcaagtgaaacactcgctttatgagaagctggctttggatgcaatatttaacaactgccactttatcagtaagcctgatatcgaaatatgtcaatcgcttctcttactatcttgtgtcaaatggggtcataatgattattttgcagcctggatgctgcatggttgtgctgtgaggatgatacaggcaattcagtttgacgaaaggtttcaacacagttgtaaacaagacccgttgttgaacgagctacggaatagaactttttggtccgcattttgcttggatagagttatttctactggtgaaggtcattgttttacagtcaatcgattcatggacgttgaattaccacttcctgaatcatatttctttgggctttccggtgttagcaataccggtaaaacaaatgttccattaaacggtgatgtatatggtttatccaaaataaactcccagtcgtcggatattggaatagaacaagaagtcagtgcttctaatacccaattggctgctgctttcaatatccagttgaaaagtaaagtcaccattggttcttttaacaagttttacaaagcttacccccaattgttactccaaaacgaaagatccgccttcattaagtgctattcgttatggggctccataaatgagtacatgatggacggtggtagagtaaaaaggtcggctgaggttccatgggatttagaaaactctactgttgggaaaataacaaaagaggtggatgatttctggaatgtgatacctgcggaatggaaatgggggaattttgattatgccagtcaacgcccatatcatatcaaaaagcttttcatgataacttcaatgaattgcttgcattttttgactataatattttgcattagggaatatcttccatttttaccttcaaaagaattaggtccctgcggaccaatcgaaccaccttttatgccacaaccaccatacacaacctattggtcagatatgtcgagaaagtgttttgcagcactacgacaactttgtgaaattttaaaggtagttttcgaaacggaatctgaaaacactaaaggatctattaatctcatcgaatcatcacctttcttctcattttgcgcttttgtttgtgctatccagtgcaattacggttcaaatttccctttcatggaccctgacgcagctttatataagaagaataaagacaaaaatctatcatattgctataaaatggtattaaagattctcaagtcaagggagagtttttgcccagtcactaagaactggttgcatatggttttcaaagttcaggagatgtataaatctgttgctggtagcaggactagcagcaaggtagtcccgaacggctcagaacaaacccagacttatgttcctatccagccgacaattttgaatcctaattcatctcaaaatacgttccagcgtcctgcggacccccctggtatatcacaaagcaccgcacaaagaattcagaaccaatctcttccaaactatggtgccccactgccgttgggtcagttgatgtcaccatcagattcaatggcaagcaatcgagatcaactaccctcgggctcgagctcactcattccagatagcagttcctcgattatagtgggcactggctcagatgggatttttggctctaatattggaaatagcgaaaacaacggattacttacgaacagtaaaaccacaccagtacttcaacatgctacgacgacctcggacattgcttcaggatcttcatccaatccaagtagcacccctagattccctatagaagtggaacctgagacggataaattatcgctcttattttcggatcaagaatttgagatgttgatgcaattttccaaataggtaaggtgaaaaattcctaagccttaaattgtaacactatttcattgaatattataaacaaaaagttttggcatattaaacctcaagttaacactggcaaagtttctcaccaaagactacataaattgctatgaaaaatgcaaaacaaaaaaaacacaaaacaagaaaggactacgaagttctaacaaagaagtggacaaggaagtaggttttgcatccgtcttcatatactaatctgttatttttgtcagagtgataatcgtgtatgtatatgataacattattccccaacggacgcacaattgtttttttctaattcttttcataaaactacgtagatcaacggttaacggaagtaaacgtttgtaatactattcagagattctcacgattccagaggacaggtgcgctcagcaatgctttaatatgtgctgtcgtcgtttttatatccattagtcttttattatggtggtgacagtattaattagccttgtgatacatcatcgtaaacgtttcacgtgatcttgtttctttttgacaatttttcaagtcttcaattttagcgatgagatgagatgagatgaaataggttgaggaagaatacaatccgggcaaagctcgagtgttgtctcatcttcatcttccagtggcaacttcccatcactactatcacaaacgcagagtctataaatgaaaagatcatccgaagaagtgaaggctctacgcctgatcaagagatttaaaaagacaagtaagaatccaattgatgaggaagatggatgttctaaatgtatagtaagggttccggtgttcatgtacgtttctctggcaccaatttatcagcaactacctaaggaaggtattatgagacaacatcttaacggaatggttatgaaatacaatgccgatgttggaggagttatcctgggatatgaaaacctatcgattcttggtgaagaacctactgaggaagatgagaaactgatgaagttaacagcggatactccatttgctttcacttggtgtaacgttgaagttatcgtgtggcaacctcaggttggtgataccattgaaggttggattttcatccaatctgcgtcccacattggtcttttgatccacgatgctttcaacgcaagcattaaaaaaaacaacattcctaatgattggacgttcattcataacgaagagaccactgaaaacggacaagactctacagatgatagaaaattccaatcccttggtcattgggtcgatggtaatggccaacaactcggtggtaaactaaaattcaaagtaaaaaatgtttacactactggcagaatggtttcattggaaggtaccctacttgacgattctgctagaggttcccattcagaagcggaaaacttacctgtagtttcaaacaagaaaattgttttcgatgatgaagtttctaaagagaatacagattcacacaaagaactggaattgtcggtggtcaaggaagataatggagatgaaattatttatgaaaaagactccagtgatagcgacagtagtgagagtgattaaagtgagactagtttatatgaaattatttctagagccatatgtgtattaaataatactaactatttctattccatctttaattcagttactggttgtataatattttgtcagtttgtatgcactttctaattattcaagtgttcgcgaaaataaaaacagaacataaaagatcaacaaacgcaggaaaacagaacagagcagaatagctccaagtgacctggactctacagccacttagtgaggtcactttaaaaatatccaatgactacaccaactatgcagagtacgtccttgttgacggaacatttgggttatccaccaatttctttagttgacgacattatcaatgccgtcaatgagattatgtacaagtgcactaatgcgatggagaagtatttaatgcaaaggaatatcattgggaagaaagatttctctgacgaaattaaaataggtaccgccaaactagaatctttgttggaaaactctgtggataagaactttgataaacttgagctctatgtgttaaggaatatattatccataccctctgatctacttgaagaaaatagatttagattactacatcacgagaagcttgtattaactgattcagctactcgcgctcatacggatacatctattgagcagaaactacaagaaatagaaagacaatatcagttgaatgttatgttgagggatagaattcagaacaccaaggaactccttacggaagtggtacaattcaagaaaaaggtgatagatcttctacgatgcgacgataacttgacaactgcgttgcatgaattatgggacgatctaaaacctctagatgtggctgttaagcttattacaacaagattaaagcagatatatttggagaatgaggaattctattcgattgaccaagtaaacagactggtgaaaaggtataatgaattgagaaatacttcaattgtgagaaacggctacattgataaaaaatctcaacatattttagatgaattacacattagtgttaattcaactcagaacaatgaagattctacaaatacctctattcgatcattgcaggaagatgatcctgaaatagaacatccagattggtcatcgatgcagaaggtaatataacctctgcatctacaattctaaatggagaaaatacacgtgagctgggatcacgtatcctgatggaaattagttaacaataaactttgacttaatattattaaacagtgatatagtaattaaataatagaggatgaataaaataaatgacagtgccagtaccctaaaaagtaacgggaataattaaagtcgaaacatgataaaaaaataaaaagtcgatacagtaccgaaaatgatgaacgcctaggataataaaataatgtaatgagaaaaaatgaaatacaatgtaaaagtccgcctagttgattaataggtaaaagaaaaaagaattagcgaagtgattgatgcgaatagaataatatatcccgaaattaataatgatgagtgatgataatacaatgatactgtcggggaataggaaacaaataaatggtaaaatcagtctagaagaaggaggaaaagaaaaaaaaagttgaaatagaaaacctgaaatcaagtccacaagtgggtggacacatgatgatgaatgatttgtttagaaactgtgaaaaattgggtatcgtgtgagagtctttgtacctggagtcgataacagggacagtaaagatgagcttagtgataagaagttacaaaaacctcttgaaatgagaatcctgcaaccaacctattttctcataggcagcaaatagtctggaggctttgtttacatcgatacgacatgccttttgagcatctgtcctcctgaatggcataccttgttttaaacgatgcaccttttcaatgaaaaatcttctcttagaatccaggtataaatcgcaaggtaatcttaagatttgagctaaaactaattcagcaggatgcaatttatttctcaaaggatcatgagataaatccattgatgaacccttccaatcaacttttaagcatttgttgttattcggaggtagagtatccaacgaaggagaatagtcaggcaacttttcccaggacatgttaaccgtatggtgatgatggttagccgaggaggagcctgcagcagtagtgatggatgaatgagatagtggtgatgggtgatggtgagaaacgggtttcctccttgaaacaggagttaccggtctttgtcttggtaaataaggaacagcagaagagtcatcggaagtggcaccaccatttctagtactagtggtattaccgcctgtggtacgtcttgttctgtaaaccctttcgaaatcggaattcgaagcataggtcttgttcgaagttctggttcttctggtgtatcttgaaataggagaaacacttcttccgccaaagttggaagatatttttggtttcagaactttatactgggacaaaaaggcatttatgtgcaattgataagtcttggttccgttttccttattgtaattgtcccaaacacctttcacaacgatcccatcgagagacgactcttcagggtgttcttgttgttggtcaatttccttcagtttgatctccaatcctgtgatattaagcggttggtttcctctagcaacaaccgatccatcttcggcagaagtgtgcgaggtattgcgatgcgtatctgtttctttaggagaaagtggcggggaggggatcaggtactcgtctacaggttcgtacagagcagcatcacggccagccatgggccttggtgccaacaaagtgaacccgttcccaagtatcacagcacgtgaacctgtttcatcctgagtaatattcttatcgatgctatttgcattacgcgaaccgttagcatcggatgtatttgccagaatcctttcgttcaaactcgagataatgttagaagtgcccttcgggtgtactatcgtaccttgcccttgcaattgtatgtgttctggacgaggtgaattgaattccatttgtgttgtgtaagttagaaagtttctttttttttctctgttcaagtttcttttaaatttaataataatgcgatgagatgagtataatcaattcaaaaacaaaccgataaaataatattctttttcaattagtagctagattcgggacgattgcaattggatatcaattgaaatactaatcgtttgtgtatatgattgctctcttgagacaattcaattcaactcaatcaataatttagtacttttctccgtatcaacaacaatgataaaaacataaatagtagatagttcaagtaccagactgactcaaaaataaaaacactcaactgtatatttataccaggagacggggcaaaacaaacaaatccgaacaaaaaaatgcctttctctcagtttctttctgcaatgatgtatccagaaacagaaacagtcactccgtgttttctggtatctttttgatttttttttttcttgacataatacaaaagtaagacaaaactcaaggtgaaagaaagcccgaagtaaaggtcaattgccgtcagcaatagtgcgatttgtaagtgactttacaagcctcttagcagtggggtgttcggtcatggttattccatggccgaggtcccttttagcctctttttacccactctcagttcaatcatgttactctctctgctttctggccgtatgtcactggttaccatggaactgttttggggggaagagaagccagagacatcagatggtgcgttgatttctgtgtcgcctgacgccagtaacgggggtcaaaaaaaagaaaagtgcttactaagggaagatgacttaatggaaaataaaagaaacggcggaaagtcgtttcttttttaaagaattgcacgtgaatatcacgtgcaattcagcaccacaacggtcctcctcctttcttcaaacttggtagctcgggtttatattccaagtgtcgaaaccaaacacttgcttaatcaggtcgtcaatctcatcagatagggagaaatcgtgtatgttgttcatttgatggaacccttggaaaccctggtagccctggtaaccctggtgtgggtttaaatgcgtctgatgtgccgagttttcttgttgttgttgttccaattctagatcctcttcttctatcttgtttggtaaatcgtacatgtttgatagatcatggaacacagatttgaaccaatttagctcgagggacaagttcggaaaaacggagtcgatgacgctgtcggaccccatagatttcaatttttggaaacaggaaatcgatagcaaacatgtgtataaatggtataaagtagcttgtcttaatccgttaccgaattttaatttcagattgctcaataacgtctttagatcacccaagatttccaaaatcacagtcttggattcctcacagtcttccatgaacggcttgttgaacgtgattaggacgatgtagtaatggtaccaaaaatacgagatagttgggtccgtactcatatcgacgctttgtaccaggctcttggaccatttgaggaattctggaagggattgcctccaattggataccttgaggttgaattttttcaagtattcaattcgccttgatgtggtgttaggctcaataaatatcttcgacgtgaagatctgaataattctggataaaatcatcaaattctttaatggttgtgaaacttgtaacaccgtttgggattcgtacctgaaatcttcggttccctcaatctctggtagttcatcactctcgggaacggttgaatttgacaccgttaaactgggtgctcttccaagaattaagcatataaaatgatccgcaatgtaacaaccccaatatattctggatctgatttctaattcactgtcactcaaatcttggttctcgttgatactgtcatcagtgatccacactttcggatctaattggaaccccatgtcatatccaactctgatagcaagtccactgaaataccatgctaattggttttcaccgtttcctaattcgtaaaatgctaggcacaatagtgcttgtaccgtggtgatcttggctatactttgctcttcaaatacaattttcaacaatcgggtcttggctatttgataatatttctcggataaatgatgtaaatctttcgacaatctacttcctatggccgctactgcatatattaactcctctgaacaatgctgtgaattatcatatgtttcatctgtatgattgaagaatccatataagaaagactctctatggacaaaaatgaagtttccagggtaaagccatttataaaaattggacaaactttggatgatagcgggatctgaatttaatctgccatcattagggtcgatttggtttctaacaatcaccgtgctcttcaaatcaccgatacgttgggtaggttgtgaaaatatcgaggtggtgtcccgtttacgtttcttatatgacgtaggaccctctggataaatactgcccttcacaaactttttatttctcaaaacatcatgatgcacagatgagttggatagtgaagagtcgtttgattgagcagaaggtggcctattgtttccaaccgtattctcattatcgtcaacatatccatcagagggcacattgcacgagctatctacatttgaaggcaaacttttgattaaaacaggtgtgttgggtttagctgccgtgattggcgacccagtagacggcataggcgataaaccattcaaaacttcgtcaaccataagtcttttaatatcggttgcatcttctggcaaaatttcatcagcaagtttagcatactgtcgtagccgaagctccatttcggcaacatggtcttcaagatttttaacgtatgtcaaattatacctcttcttacgcaagtccactttgttgatattacatccaagccctaattcttgacaccttccacagggatactccaagtcacatttcttccgacgacgacggcaatttgcacaagctaaacgcttagcaggtggttccgaggatgcttcactatccatttgaagtttagtttcatgttgtgaagtttcatttttgtgttgctggtgggaagtatgcttctcgaagtttaccattaatatccattcactaataaaatcaaacgatacaaccagaaaaaaggctattgtgaagcgcaaattgtataggtaaatttgtggcaaaggcgatatcttctttgtataccctaccaacagttcgtttccagctacgtaactaaatttctaaaccttattttataccgctgagtcgaataacttagcatatacattttattcatgttggttatttttcaccgttcgttttatttttttcgggaattaatcactggtgttaatgcatagtatactcatataaatagtgaatggatagtaaatgaatgatgatacgtttttagtgactaaactactcaatcaagtcctggctttgatatcttaattatgatgaattggtatctatggtaacttatttcataaatctacacagagaatgttatcaattatgaaataattcgaataatataaacctgtcaagagagtttgcattgtacgaaatggagttgaacttggaggtcataattcgtcttgttcaaatagctcatcagtatgttcttccaaaggtgcaattggcaccttgagctggatactattcacaaggtctgctctgaagttgtttaatgaaatgaaacttttagaaaggagatgataatgtaatcttaaactcgttccagcatctatctctctccattttttcatgttaataatgtatgatgacgatagatcgtagaatggtaggtcatatttctgtaaatactttttccagtatccgaagttccagtacgaaccttcttttgtttttgccggtttcaagtagaacacagcatcagagaatgaagcaatatcgttccatggaatagtgtcacttgaatcatcagttaaagaaagtaccactaagtagtcaacgttttttggaaccattgtgtctaacagcaaaatagatttcgcctcaagctcttttgctgagaaccgctgtggtctcaaccataatggccaagtatacgttaacaaatgatagtcaactgaagctggcatttctcggacaattaacttaggtctctgagctaaaatataaaattttgctttgtcgccaatttctttcttgactctttcaattcttttaacggccacactttcttgtccatcatgcacgacaaccattacattcactctgtcgtctttttcgttcataatttccgcagtagtctttctcactttgacatgaatttgggtaggcaatgagttatcaacatcaaaggattctacttcaatataatttgcttctgccattgtcgacaatgctgtaatctcgtaacttgaatcacagttttccaacttcaatcccttttgcaagctaggtaatgataattggacatatccaaatgatttcatcgaaagacctttatcgataacatttcctgcgttgtccattagctgcaagcatacaccggccagaccatcaataatgtcaattgacacatcgtcaccttcatcgaatacatgggcttcaataattattgatttgtcatctgggttgatgttatgaggataatcaaattctgataagaatccattatctgatatcccggttgaagcattgtagaatctatgcactgggttcaatgttagattggctgtcggtaccaatgcaacctctgtttttacaaatggcaagtctttcaataaacttgacaaatataacaaccgctgtgtcctttcttcaacaggatctagcaatagagtgacgttgattacagattgatcagagcggctagtgatagtgtattcttctaactcagaaagactcactcgaggcattgaggattctgtagtgtaaggtattccgttattcaatacaaggtaaccatgatgtacatatttgataacagcagcagtaagttcctcgatagcagatgggttcattatgttttcgtccaacgccccgatgtgatgtagtgtcttcaatacatcaagggtgcgcgaagaatgatgaaccaaaatgttgtgccataattcaacagaatacaaatcgtcatccgtattgaaaaatttaccattgattactgcaaatggtttacgaagagctttaatagaaatatccggcaaccaagagcttaaaacattcaaaaagggatcaacaatgaaattaacagtcgtcttagaggctattttacctgacaacttccctgtgctgaattccattttaaaattatcccaactctttgacaaatcaccaacgtgaactagtctgaaactaacacttttgtgattgttccttagtagggctcgtatcttctgaacagcgctataagagttgaaatcatcgactaaagtgatagtatgaatgggtgaagtcttttgattcggatcagaaaagattatcgtgcgactaccgagtacatgtagagcgcggttgttaactctggtgaaggtttcatccagcatacggttaggtatgtataccggatttttcaatgtcaaggacctatggtgaagaagttgccttactgataggttagatgaatcacccaaggcctgcaattctgacttcaaatactcgatatcggcggataatatccttgaagtatgaatcttccatgctttagcttggaatggtaaaagtacaccattcattgctatgcaagtatctgctattttgaatctctcaaggtattcatcatacgcactgcctttgtgttttgtctgaggttgaattttttcagagtgtccaataagagttcttaagtaatctattatcgactgcagaggcttgtcagattccgacttcaatttataaatcatatcgacaacagagttcgatccagaggaagaaaatggaattaagcccaacctgataggatatccagtttccatctgatcgattgcttgtaacaatgatcctacagcaccgtcatctttgaattgtgtcatatcgtcaaagttaataaaaaagatgagctcattccaattctgcttgatgctaggaattggttcgaaatcagatggttccaaaaacgccatattgtcttcaggcaggtccttatatagctcatccttctcgaaattattgaagaaaactacagcttcagagaaacctggagtacgatagaaatcgtaacgatttttgtcaaagtaagccgtatatgagtagccaaccgtgaaatatttcaaaaagttctctaactcagcaccggggaacttacttagtttttcttttaaatcattaaccctagaccattccttagcgaggatagcaggtaaagtagtttcatctaattctgacaatctccactgttggccgttgatgtacaagccaagtaattcatgagagatttttctcttattgaagtctttaacaatattctttgctggtgttgtatcaatgttgtctttagaagcaatgactggtgccactgcaggaaaattgtaggacaacgacttgaaatattcaaagaaagaatcgaaatcatgatcttcattgaatttctccaacaataacgcggtgaatttcatatccaaatcttctagttccttttgatccaagtatttcaatttgactggatccttaatttttagatcagaatcatcgattacaaggtgaacatttgccttttggtcccagtttttgtccgataatgtggcactcaatgcatattctggtgtatcacctatgatacaggtcggtctccaagtcattctaatcttaccaaacttagcctcattataaagatttctgttgaaatcagcaaactctaaatctgtttcacaaccgtaaagtaccacaattggagcagaagcattagttccgattgcaatctctctatcttttaacacatcgaaatctggaacaagagcttgagcatccaattcagaggtcttgaaataaaatgagtcatcgctcttagagtatattttgccattcaaaacaaagcaagtttctttgaattcatcatcaattggtgcaatctgtacatattttgaaatggcaccggacaagccttcgacttgttgtactttctcagccgaagctgaacttatagattcctcaattccttcatcgtcatcttcatcttcttcatcctcttcttcatcacttaacgttatttttctatacaactgcatccattggtcggtagacaatgcatcgtaatcaacaagggacgctgaaagccatctcttaccaattccttcattaaatgcttgcgttatgtgcaggacagttaacagcaaaaacacaattcgtaacctaaacaagaccatcgtggttttgcaccgttttagatcaggaaactcgttcactcaatcttgttggaacacaaactgtcaaattgtgctgatctaaatactctctttcatctcgaattctgatcttaatagaaggcaaatataaaccttaaaaatcttgcgggatcttctgccaataaaaaacttttaagctggaaatatgaagcatgttaaagtcctacacatgttatagaatttgtaaacctcaccattactataatgctactccctaagctagtactatgggattttacgcatgtctatcagatccactggcaaggtagcttcagccactttcgaatgaagagtcacgtgagtgtatttctcacgtgactcctagtttctttcttcattggctctatctatctgtgaaacggaaagcgttgagaaaaatatcaaaaagtgatttgaagatattctggaatttttgaacaattaacttatacataaaaacggatgagtagaaggcttggactcaggttcagaggctactactgctctttcgtttgttgtattcgaaagttattgaaaaccttaggcggcatattcagagaactagggggatttctgaacttttttcccgttgtttcaagtcgttaatttaatcattactcatcgtttttagcggtttgattaaatcttcccgttcttgattagaatttgctttcgaagacgtccttaggaaaggtgtttcgcgttaattgcaggttattttccagttttacagctaggatgacgattggtgataagtctaagtggacggctgccaacgttcgttccacatttttggactatttcaagtctaagggccatacttttgttccatcttcacccgtgattccattcgatgatccaactttattgtttgccaatgctggtatgaatcagtataagccaatctttttgggaacagttgacccatccagtgatttttacaagttgaagagagctacgaactctcaaaagtgtatcagagccggtggtaagcataatgatttggaagatgttggtagagactcctaccaccacactttctttgaaatgttgggtaactggtcgttcggtgactatttcaagaaggaagctattgaatactcttgggaattgttgaccaaagtctacggtattccaggtgatagattgtacgtcacttatttcgaaggtgacgaaaaattgggtttggaaccagacttcgaagctcgtgatttgtggaaatccgttggcgtcaaggatgatcatatcttgccaggtaatgccaaggataacttttgggaaatgggtgaacaaggtccatgtggtccttgttctgaagttcattatgacagaattggtggtagaaacgctgctcatcttgttaatcaagacgatccagatgtgttggaaatttggaataacgtttttattcaattcaacagagaacaagatcgttctctaagagctctaccggctaaacatgtcgatactggtatgggtttcgaaagattggtgtccgttttgcacgatgttagatctaattacgacaccgacgttttcgaacctttgttcaaccgtatccaagaaatcactggggtcagatcatacactggtaaatttggtgctgaggatacggatggtattgacaccgcttacagagtcttggctgatcatgttcgtacgttaactttcgccttggctgatggtggtgttcctaacaacgaaggtagaggttacgttttgagaagaattttgagacgtggtgcacgttacgctagaaagtacatgaactaccctataggaaactttttttcacaattgtctgtcactttaatcgaacaagttaaggatatgttcccagaagtcgctagagacccatcttatttgttcgaaattttggacgaagaagaagcttctttcgcaaaaactttagaccgtggtgaaaaattgtttgaaaagtatgctgaagatgctttgaagaaagcagacaagactttggatggtaaacaagtctggagactatacgatacttatggtttccctgtcgatttgactgaattgatggctgaagaacagggcttaaagatcgatacaatcggttttgagaaagctaaacaggaatcatacgaggcttctaagaaaggtggtaagaagggtgcatctgatttgatcagattaaacgttcatgaattgtctcaacttaacggtgataatgtcgctaagactgatgattcatctaagtatgggaccgaaaacgttgaagccactattttgagaatatatgatggtgagaaattcgttgactctatgaccgaaattggtaagcaatatggtgttattctagacaaaacttgtttttatgccgaacaaggtggtcaagagttcgatacaggtaagttggttatcgatggtgaagcagaattcaacgtcgacaatgttcaagcctacaacggttatgttttccataccggttctcttggtgacggtaaactatctattggtgacagtataattgcttcttacgaagagctacgtcgtcatcccctaagaaataatcacactggtacacatatcttgaactttgctctgaaagaagtgttgggtaatgatgtcgatcaaaagggttccttagttgcaccggaaaagttgagattcgatttctcgcacaagagagccttatcttatgaggaattagtggaggttgaaaaactctccaatgaaaagatcagggacaacttaactgtgtattacaaggaagttgccttagatttggctaagactatctcttctgtccgtgctgtcttcggtgaaacttacccggatccagttcgtgttgtttctattggtaaggccgttgaagaagtcctagagaacccaactagtgaagaatggcaaaagtactccattgaattctgtggtggtacccatgttgctaagactagtgacatcaaagaattcgtcattgttgaagaaagtggtattgccaaaggtatcagaagaattgttgcggtttctggacctgaagcctatgaagtacaaagaattgctactgaatttgatggcgaattaactgcagttgaaaaactgcctttctcccctttaaaggcccaaaagctaaaggagctaggtgtcagactaggccaactaactatttccgttatcaccaaaactgacttgaaggataaattcaacaaaattgaaaaggaagttaaagatgaactgaaatctagagctaagaaggaaattaaacaaactctggacgacgtcaaacatcactttgatgctaacaaagagtcttctttctacgtcaagcatattgacattccaactaatgctaaggccatcactgaagctatcaatcacattaaaacaaactcgaaggacaagtctatctacttattcacttgtaatgaaccagacggaaaggttgctcacggatgctacatatctgacgcagcaattgctcaaggtgttgatggttctagtttagccaaaacagtatcctctagcatcggtggtaaagctggtggtaagggaaatgtcttccaaggtatgggtgacaaaccaaacggtattgactccgctgttgcggaagttgaagccttgctaaaagagagactgactatctaatttcacccgctttaatataaactctttggctacgattggcttgaagttaatctcaagtctcaaagttttgtaaatatatgcatgagaactctgattttcaactcaactatatatgatattacttgaaagatatgctacgccttttgttatatagagaatgaattatctgatatttacacaatctgttagttaaggttggtgatgcggcaataatgcataaaatattggacatgcttggcgtattctcgttcttcttctgtgacttgaatgcgacaaaccaaaaaaaaaaaaaaaaaaaaaaaaaagagagatgcttcacattacaagatttagagttatgatggagatcaactgtgaaggaatcaagattttgataaaggacggttgtgcaacaacgtttattcgggggtttcatcctactattaataaaacttgctgtcataataggcaaaatagaagaaatccaatggttcgtttaaagagcagatacattcttttcgaagtactatatccagatgtagatgatgagtacgaaacagtgccagatataaccaagaaggacattttaaccacgcatcacaaagtatcaccaaatactatcagtccgagaaatattttgcaggaactacgaaaacaattacaggtgaatttcggggactatggcttgggaaaggctacggctttgttacagatcaaatacttttcgaatagaacatcaaccggtataatacgatgtggccatgatgaccatcagtacgtaataatggcacttgctttgatgaaccagattgaatctgttgggcccatcataatgaatccaataaaagttagcggaactattaaaaaagttgagttatttgctatcagaagaagtcaccgtttgaaccgaatacttctgacagatgataggaatgatgagttttcttcaatcactgacgatgaaaataatgactgattcgctgatttcattcaattagtagtgcttgaatattattacatacaattatatcagtatatcggtatcgcacaattaagaagtatgaggcttcttacgcacttgaagaccgtattctctggcatgctcgttatcttcctcattctgttccgcatttttgccatcatcagcagcggagaactctaccggtccagttcttcctttcttatttgagagtcgatcaacaatatcttcgttttctaagttagaaccagtagttggcctgtaaatgttgtcaatctggctattattgaacaatggatggtcgaaaatttgatttgaagatgatgccacagatgatgccgctttcttgaacaagcgggaatcgtactgaagatctggggtctcggtggcttttgcagcatttaaaacaactttatcagaaacatctcttccttgttggtacgccaatcgtcttaacttttctgctgtgctcattttattcgaccgttccaattcgcgttctgctctcctacgttgattacgctccatttccctaacataatgatcttcattttcgtactgtcgcctattttccctatcctgtctagcacgttcagctaagtgacgtaacctttgttctttttttaaagtttcttccttctctaactccttgtacgcctcttgcttaatgttgattctctgtcttgcttctctttctgcttcgtctagtgcctcagatagcagaaggaaattgtccttcttatcattatctgggcagtccgtctttattgattcaatagcaactctattatccaaagaaatagcaaatccgttaggattcttccagttcgaaatggcggatggaattctccatttatcaagctcttcctttgtaggtttaatactagggtcatccgacttatgaagtataggcgcctgaatttcttccgatggtacaacgaccttccttttcctgtgtgttaccggttgtaaaggatccttcttatgttctattactttaactgaacgttgagtaccagattttacagagcttattgcttctctttttacgatgtccttgttcgcaatagacgataattgtagagagctctttttcgttagcagcgagtctagaaacgccttagtctttacatatgtttgattaatctgtgatgtcgatgggaacggtgcctctagtgatatatcacgttgtctaagaggtacaaagtcagatattgaggccactggtagattctccggtcgtagcttgtctaatattattgtatcctttatgttttccttagattgtctagaaaatgctgaagactcggagacttctgagttttgcggactcggtagcaatgagctgagtgtcctgaatgacatgtcagaccgttctagtggtgttataacaggtttgttcctatgtttcaagccttacctactttactttataaattatgggaatgttcaatagttaaatattttctctaaatttcaaatacattgttaaaagttgatattataatggaaataagttcactgcaaatagaaattaaaagattctttctatttaaacagtttatccttgattttacccactattttagtatccgccccttgacctgatgagtacatgctgtcaaaaccgaactttttatcagaaccttggtctctggagatcaaacttgtgcgaaatgcaagaccctcttgagttgttctgaatttttgaagtgagtgctgtgcaggtggaggtggataatgcaacacggcaggcttcttgtaccatccgcgtcttttaggctcagggttttcatcttgtgacataggcggaacccctataaatctcacctttttcacaataccttcaacttcgctgtcgttgtttgaagacgactgattgtcatcggcaacagaaactatgatcttaggagtttcactaccttctggagataacacttcctgagagacgattagagtatcatcgtccagcttcagatcgtggaatttctcattgatgtcatcttcgtctacttcatttagcttcaatatgttcactttgttcctctgttttacggaattctgccgtgacacagttggagaaggtgattttgatcttatagaattattcagctttgttggtgttagtcttgggcctcttttctcatttaacgagagtaatgcttttgaatatgcattctgtacaattctttgtgtattcagagaacctgattgaagagaattggatctcataccattccgagcagtggaagtatcttcaagacttgatactgattgcaatgatgacgatctgtttcttgttctgactgatctggtctttttagccgatatattagacttcgcatcagtgaaaggtattggtgatgatggggaccttgattcttctgaccgcgaaactgaagatgtccggctcagtcttaaaggcgataaaatatttggagaaacgtttaatgaggaagaatttgaagttatggaagatgaagatgatgtgtttttttgtgaaagactggaattctttttttcctccctttgtctttcttgttcctttattttttcgttgtatgctagttcatctacagctaacttttcctccgccatctttgccatctcatcgatgttcatatcgtcatatttgctggctttcatgttatctgatatacttttccattgggtgctaaacgaatcaacgagtttagcagctttccgtaacatctgcgtagattttaacaacaatctttgatatgctgatgagatgttgttaaactgaacttgataaacagtattctggtttccatatgacttaaaggcctctataagatctttttcaagttcctgtgtgaagcaaaacgtttctaactcttccaatagctcagaatattcgtgtagattctttgaatgcaatttggtagtgttatcatggaagtgatgtttatttggaatgtaaatttgtctcaatacagcccgtatcacatcgatgagacattttgctctaagagatgcagcatacatcctatgcaaagtaaactgccagtatggcaattggatgagaacattattcgagaaaacgccctttgttcggctgaatttcattatactagtgtaatatgatcgtatagggggtatgcacttatcattgaggttagacctgaatttctctaagattggtaaagccaaagcaaagaaggcagagctgcttgtatcggttgatctattcctaatattaacaagtaagtcaagtccgaatgctaactcgtttggtgaaagaagatcgtttagcgcatcttcgttgaagatagttgtccttccagataggtctgtaggtctgtttgagttcctttccatggtcagttgcctaattcttgcttggtatatctgaagtgaatcttctgctactcgttgtaacgtggtaagtaattgcgattgtaattctttgttgtagaatttactgacgaacaagacagagtcttcttccaccggtacaaggtcaacctctagtttgagagaagtggtgctcaatggcagatttgtagcattggctttacatgatctaaattgtgagagtagttcgatccttttttctatggccgcagatacattaaattgaaaccctgaaccaagagctatcacgatgtttgacaaggggataagattctcattactcttcattgacaaattcctaagcaacactttacagacgtgaaccagttgctcgagtttccgtatcgatgatgtatattgtatgcattttatatctgtaaaatccaaatacacactacccttttccatagatgaggaagcactagctgccgccttcgccagcataattggaaaaaaacgtaattattgcagttctcgatggtcccaaagtagatataccttctgataagtcagcgaatggtgtatatttgcttcaattgcagccaagtcttgccgagtacgatgtctcttttcagttgggcgaattttaagaaacctttttatttttttttttgacgttgcagaagataccaaccagatggacagagatgtatcaagaattcgcaaataggtaatcataaaactcatgatatttgtatcacaagtaaagttattgctttaatctataaaaatgtttaaaaaatagagataacttgcttgcgatcaggaaattatctatttacaggatgtggctatacggatttttcacttcttgtcgtcatctactaaccatttccagatcatgtctctctttgatccatctttgtacaatacttcacgtccagaccataacacccttgcactcgttaaccacctatcccagaatgtaggtatttctttgtctagagctaacttagcatttgccaaatgctttttattgttagcaccggtatgattattcaatagtgtcaattttgtgactgaccttagagctctcatatttgtgatagttacaactgctgcagctgctactgacagtccaactacactggcaaatccccagtttgaatcttcgatgaagtttttcaaattcatcccataaaatgccggaacaagtgtggccaccgtaaaacctaacgtataaacagtaactttcaattcgaatagcaacaatgagttccggttggcatctagaataatattgacaatttcctcggtagatttgatatcttgaatgagagattcggattgttgcacatattcgtcacactgtttgtaatatgtctctaagagcatttcaaggtccgaatggtcgtcagcatctggatgcttcttctcgctgaggtacattccggccaaatcctcatctgactctagaagttcgtctaaaaggtcacgtagtaagacactcttctgggcaaaagcagtcaaagttttggatttgatcaaaagatctctaagcttgtctcggtcaatctgattctccaaatcgttcaatatcatcccacaaacagaatgatgatacttgtattccgtttccaaacaggtcatcacgtttatgagtattgattcgagggctctatgttcataattttcctggtatgagacagatttcccttggtaattgatattcctttgagatagttttgattccaagtcatacattaacacaccaagttttatggcggcgtcaggatttgtagtatcaaacacgaaaactttatctttctgtatcattgcttttatatgtaacacattcaccaaaatgcacttaggtttgatgacaaacgaaggtattacatctattgtactcgagtcaatcttcctcaaatctcttggatataacccatatttctgtaagaactcccatttcgggaatttatgagatacagcagtcacgtcacctttctcgttgaaaatggtacatgatacgtaagattcatgaggcgtcacaggtttcaccaagaaaggatgctgtgttgaagcgattggtttgatgagttttgtcgtcgagttccatcgaagttgtgatcggacggctttagaagagtgtcgaagttggatttgaagcccttttccaaaacggaaatacataagagatagttatgtcagcttgatattctatgctaaagctcccagttgaacctcagttttcaagcggtattcttagatctatgctgaacttttttgtttcaacagatacttgtgtgcaatgaaagtgtttgcacaattttgtcaatatatagaaattagcgaacgtacattgcaaatagaaatcaaagggccacaagtgaactgcaacacggaaagacagccatatatccaatatacctagtcttccagcaccgtgtgagttctcctaatattaaatcgaaattatccatcttttaattgcattatttatctattatgtcgtctgttatataagaagtgagtccgatgaatcacgatagccttattttaaatcagaggaacatcgtaataaggtcaatcttgcttctttattgaaacttatgtgatcaatcgaagaactttctggtcttagatgggccgaacaattctagtctgatagcaggtaacgattcttcacttaacaacttcaatctttcttccaaagtgttatcgacttcaattctcccgtttccgttggaaacaatgacaccaccagcaatgtctttgttcaaataggagctggaaagctcgatcttaatgggcttgccagttttttcctcgtattccttagccacatcatctactaaagattcgatgatttccacgtccgtttctctaaccttgatgatagcacttggttcaagcaatttcaacaaggattccaggactaaagaatgcaaaactggcttgtattcctccttcttagaagaaatctgctttaattcagccttggtcttctcgaagatgctatccaacacttcttctcttgttcccaacactttcaatctcatcttattggcgatagtggacttcacaatctgttgtttcaaagcagccttcttcattctagaagcaatgttattgtcaatggcactggtctcgttgcgtacaagaccagttttctcaatttcatactcctgttgagctttcaattcaatttctctggccttttcctcagcttccttcttgatgaaagcttgcatcttttgcaattcatcgttcacctgattaggtgatagcgcagtaatcgtggacattgttggttatatatgtatcttgatcacctagactaactcacagagttgttatcactggggactacaccttcaatgacctgacggacttgtttctatccacttgataacagtagaaacgttcttatgttcctcgtattataattgaacttatcttggtagaaaatagcctaaaggggtgatcgactatattacccggatggttaggtatcacgtggtaagttattctgacccacatccataaataggttactgtcgaggggcagatactgccaattggtatcatgtcttacatggatggctttcgtctctgatacgcataatggtctgcagtttggattagcctgtgtgtctcttttaccggtcttatgcttgatattaccgatatatgtgacgatttctgaatatttacaggctatttgagaacaaaaacagtaaacaacaacgctgaattacaagatgtgctggaccgaacaagaggaataagagaccatttatagggattaaaccctaaatatcatcgaactttaaaggtacgaagctatttctcagattcataacttccaattgagtcaaggtttggcgcctttgaattgtcaagaaaggcattataataaaggatgagatattcaattcgtttattgcagaaaggtgctggaagcataaggagggtacgatacttccatagatctgctatagtaaaggtggaggaagttgaaaaaccacgtatcaatccggtaggcattcagtacttgtcgaatagtctacacgaacaaattttcccgagcaaagacaagtataacaagttctttactgaagaggagaaacaagagctcatcaatctgtcgaagacattcttgaggaaccatgatctattggggaagccaacgaatatctccgatccaattagtttcgaattaccgaagttacaaggtcgcatattggacgagcatttccaaaaattggggcattttgcatcggagccatacaagagtatgtgtgacaataaattcaaaaatattgtaccgaggccaaagaagtggttgcgggagagagggtggtacagatatgaaccaggtaaggaaccagaaaaagtgccttatccacttgaagatactttagtatttgatgtggaagtattgtacaagatttcacattttccaacgttagcagtggcattatcagataaggcatggtacctgtggtgctcgccctttatgtgtgatggtgaaggtagtgacaatttcaaacatttaattccaatgaatactttggaaaggccaaaacttattgtaggccataacgttggttacgatagatcaaaagtacttgaagagtacaatttcactccttcaaaggcatattttatagataccatgtcattacacgttgcatcctccgggatgtgttcaagacagcgacctacttacatgaaaaagctcaaaagagatgaagaagttgcacaactcaatgcagagaatgatgatttgcctcctatagcagatgttgatgaggatagtccatggataaataaatcatcagctaattccttgaaggatgtcgcaagattccattgtaatattaagatgtccaaagaggctcgtgaatcgttcgcaactttagacaaatttgagattataaataatttcgattccatggtagagtactgtgcatttgatgtagaagccactagcaaagttttcgatgaagttttcccgaagttcttgcagaaatgccctcatccagtttcatttggggcgcttaggttcttatcgacgtctatcttgccaacaagagttggcaagtgggaaaaatatctgaattcttcagagacattgtttcaggataataaagccaagatcgaagacaagattgtcaaaatcgttgaggatactctacagcttaaaaaccaaaccgaactaattaaaaatgatccatggcttaaacaattggactggacggcggtaccagtaaaatataccaaatcaggtgaaatccgtaagaaccagaaactaccggggtatccagaatggtatcgatcgttatttccgagtaaatcgacaaccaggcctcagattacaataaggacaaggcaagttccgttatttttcaagttaacttgggaagactgtcctgtagtatatacaaactcacaaggctggtgtttccgatgtgacaattcccgggtggaagaaattttggctaaaaactacgttaaagcagtggaagttgatgattaccatgaggaagatacgactcttttcaagatcccccatccaaatggaccggaattcaattgtagtacattattatcgaaacctttcatgcattactttgaaaaaggtgttctaaaatcccaatctaaacttgctcatgatgctttacagataaatgcatcaggtgcttactggatgtctgcgagagagagaatcatgtctcaacacgtagtctccgttaatgattttaagtctgaattcaacgcaaagactccttttgataaagaccttgatgttggaataattttgccaaaacttgtacccatggggacggtcactagaagatctgttgagaacacatggttaactgcatcaaatgccaaaaaaaatagaattggctcagagttgaaatgtaacgtcgaggctcctcctggatataccttcgtcggggcagatgttgatagtgaagaactatggattgcttctttggttggtgattctatttttgatatacatggtgccactgcgattggatggatgtgtcttgaagggaccaagtcactaggcacagatttgcattctaaaacagctcacattttgggatgctcacgtgacgaagctaagatcttcaactatggtaggatatatggcgctggagttaaatttgctgcacaattattgaagaaatttaacccaatgctttcagaggatgaagctaagaaaactgctgaaaggctttatgagaacactaaaggtaaaaaacaacgctcaaccattttcaaaacattttggtacggtggatcggaatccatcttatttaacaaactagaaagtattgccgaacaagatgaacctaaaacaccagttcttggagctgggatcacttattctttaatgaagaaaaacttggggaaggacaccttcttaccttccagaatcaattgggttattcaatcatctggtgttgattatttgcatatattatgttgctccatgaactatttgatagaaaagtattcgattgatgcaagattgatgatctcaattcatgatgaaattagatacatagtatctgaaaaggacaagtacagaataactttagctttacaaatatcgaatttgtggacacgttcatatttcagtgagcaaatgtgtatcaacgatttgccccagaattgtgcattcttttctgctgttgatgttgatagagttatgagaaaagaggttgacatggactgtatcacaccatcgaacccaaatgctataccacacggtgaatcacttggaattcttgatatccttaaaatcaccaatggatacttaggcgaaccgacggatgctgtggatgtttctcaatttccgtataggcatcgtgagtccgttttcagacaatataacaaaaggtactcgaaagatttcttaaggtactctctagctatgcaaattcaagatacgaagtggaagattgacgaaattgaaaaatcttatttaagagctatggaggaagctaagttcagattggttgataatgaagtcatgacaatggcggactatatcagaggtaatacacctgatggaaaaccaaagaaacaatcaatcatgagcgatgaagtaatgtatctgaaggaaaatgacatctttgatattgacgcagaactcggcaagaagtcgaaagaaaagaagaatagaagtttcaagaaacttgctgctaagcacaaattgccttccattgataatgtaagcaatgatataattgctgacatagtaacaaaagcagtgaacgatactggcaacggaaaagaaaaactttcgtcttctaattctaagatcaaaacacgtaaacttaaacaaaaaagactggactctaacaagagtatcaaatctaatggcaaatctcttaaagtcaacactacaattgggtcagactgtcgtgataactatgcgcagcgcaagagagcattcaatgtagcaatttgatgactttaaattaatttagatagttaataaccgtgtatagcctatccgatgtaatattattaacttttctaacatatccttgaatatattagaacctactcgtaaagcattcctattaacataaataaacgtctacaaactatcaatacgcacttaatcagccagaatccacagcttttcatgactatgaggcccccgcttctgcggtaccttgaaacaattatttgcaggactaagctgaaaaattgttcttttgatatgaatcaaaacaaaaaaggtctcatcaaaatgataaatagatggatggcttgaagaaagaagtcaaacaaccgaaactccacctattctatctgagtgtgtgactgtgcaaaatgtcatttgattggttgaatgtaccagggttagatatttccaatgattcacaggcctctgtatcaagttcatcaccgcctccagcggtgtcattcagtttcactacagcagacagacctcaggaacccagtaatctgcaacaaccgcaaagtcaacaatcactgaggggacgtgagggcaataaacttactgtttcaggatctacaagtaattttcaggattcgcaatcgaagtcgcacacaatagacggagctcttcactcccattcagaatcggatattgcctcgtcgtatgtcgaaactgctcaggagttacaggtaccgctagcagttccagaattccaactcactcctgatgaacgaaaagcttacttgcgatggtttagagacctaagttccaggattcattcgcgaccaataacgttggacgatgtgtttaactttctagccaacttcaggattgacgacacgattaaagaaaggattacacacatattcagaacatgtagatacgctgtaaatgaagagcagttttatgccatcattagactagttgctcatggattacagcagcatttcctacctacccgaagcatgattcccgaaaaggcacctgtgttaagaccaaaatccatcttatctgctaatgctggtcaagaagtatatgaggaggtggaagaagacccaaacaacgctactgataaaaaggtagactttgatggatttgcatctttgctcttaacagggaaagcaatacaaaagaatatcagaaggagaatcatgaaacgtagagatcagattaagaaggtccgattctccaagaatctggttacattcgcaaacgatttatctaccaaggcaatgagcagcatctcgaggtctggcaaacctgctgtcactgcacctgataacgcagcgtctactgagtctagccctagtgatgattcaactttggacctatcactaccgatggaacaattgctagcaaaattatcttcaagaaatcgaaataacagtgctttagtgaaggaattaccctcggatactcagcctgagacacaagaagaaagagaagtattagaagatatgaaggactcattgagccatttcagacagatccaaaaagttgatagtgtcacacagctccctaacaacatgtcttcatatgaatcttctaattcttcagggagagagcaggctcttgaaccactaaaaccaacagcaactggatctgcaaactacttgttcagacagactgtccctccctctcacaatatagatgctaacaaaaacgacaaccatatcctggaaccactaaaacctactgcgactggatcagcaaacgagattttcaagaatatattcagaaggagcaaacctgcggagcatttgccacagcaggggcgtactgcaccattcgtgcctccacaaagaaaggtacagttcaccgaggcgatgaaaccaacatccacaggctcagcaaactatttaatgaagcagcaatttcaagatcttcaagaatttcagccgttccaatcggctctaccatctcagcaacaacagcaacagcagtatctcagtccacgaccatcgattaatgcttttcagcctccaaatcaaggccagtttttgcagcccaatgcaggtggattggttacatcacctcaacctcaactctcatcccattccaatctatcatctgacggatatttcagctcactcataaccccttcaccaccaatgatgcccacatcgtctcctcaacctcagaacatatcgaacggcgtgaatttatccgcagcataccagcagcatattccagagtgtggctctaacctcaattatcaagtgcgaccaaatgctgtcagtccacgaccagcacgttcccagtcagacaacattttagatgatttaaaggcattgcagcagcaagtggatcaattgaatcaaacatactcatacgatgggagacgttaaaatgtaaccaaacttccacatagcgcaagagtcgaaaatatatacaaaacgatatagaaatactcgcaacacatacttaaagacaaccctagtcttcatattcacctgttccagatggcaagtggggaagaaatagaggtaacgctgcatataagtattgtagatcaataatgcatggtaagtcccaacgtacatcttaatcacgtgaccaattgaaagatcactgctgcgaaaggaatcccagggctctttttgaccagtactggggacgaatcacctcaattcacatttcactacgttaataagataggacactgcattaaattacattaacattcaaaagtggctattatatacaaaccaaagtgtctatttcatcgctaaacttcccaaattactcttttgtaataaggaatcttaggcgcataatgggattccgcaatgttccggtccaggtatccagatagcttttaaaaactttgatttcttgacgtggttgatatccaatggttcacctggtttactaagcaagggaatatcagaagtttcaccgtatcgtttgcaataattgacgacataccttgtcgctgattcaatgacgttctctttgaacgattgtttgaaataactgttcaataggtcagtcttacggcgaagctgcaagatatgtgccaccgatatcctggttctttgaacgcaaggcctatgcatttttcaaatttggggtacgagaacatgatcgcagagaaaagttgttcctgtgtaccatttgattttaaatgagttttcttaagcccgatatttgctacgtccaatatcatcgtaaccgtttgatactcctcgaaagacttatagtattgacgtatactcatgtattattcaattccattgcataatgaatttgtggtgtcatcttgaaggagcatagtaacttcttagaaagtgtgcgttatccttacaaagaaaataatatgctccacttcctcctcttgataacataatacagagcagtcatccggaaatagctggagttcaggtttgaaacagttatcaaagaaaaacttcttggcaccttcagacacttttaggaaaactccaagttgggacaaaatgatgccataactgccagattatttttttttgatttgaggtcatcgacacatctatcgaaatgctgaaatgtttagaatatcgcatggcatgctttaattgctccttacattctttttcatatgatgatatgattggtaatccagcttgtgttgagctcgcttatgaaatccttcataccttcatcttcaatcatgttgagtggcataaagcctcttataaacttgtcaaggatacgaagcttaaaatgattaagagaaagaaattgaagaaatttctcgataaaaggaatgggtttagattcactggcatgaactgtcggaaataaatcgagtactctttgtttattagctaaacgctttctaaagagttcgtagtcacaattatgttgtggctcaagtgtctgacaatatttgatgaggcgggatttccatccaaagtagatctatgttcacgtttatcatatttgcacactgctaaaggtgatgcatcttttactctagtaacccagatcgcataaggggagggcgggagccaagtatcaaatttttttcaacttcttcgccaatattatcttcccctggacgcatgactaaagagggcttattgaagggattaaaagaaaagtcttcgaacccgaagtcgaatttcctcttgaatgctgcttctgtctgagatattcgttagcatgtgtttcgcttagatgaatggctgtcgattttgaatctgtgcttcgatctgagtcacttgaactgccataaccgtggaagttgctaggttgaaggaaagtgtcatgtggtttattttttgaattcctagactagtcccagtttgaggaagggatcgaaattgtttggataatattgacagcgccagtatactgtaaaggaccattcagttcttgagatatagcagttccatgctcatttactgaacatgaaccaattgattgttgcatgggcgtgccctgttctgctactttgcaattattgacattctgtcgagctcttcaaaatgaggaatcgttttgtgttgctctgttgaacataggtttttcagactcattctgaggttcagttgggattgatttactgttcgtgatttcacctgcatcatcgtcatcatcatcatcgtcatctttttggatatttcagagttctcttcacaagatgaaaagtgcgggtcttcaccttcttcacattttaaatcatattaaacgcctgcatcgtcatcatcatcgacaagtgtattaacagaactaacttctgagagacatgaatcgccctgtgagcgttgcttcctccgcactacaccattctgttctttaaaatatcttgttcttctttctcggagattgtacatcgttaaggaagctgcaacatttgttaaaatgtttcaattgatgttagcttatagtaatagccatgaagtgcttaattgcaggattatttacattgtaaatggaacatagtttatcgtgcatgtggtaaaatttcatttacgcgtaaagtttcgcgttttagttaatgtaacagtgaatcactatgtacgtatggattcgaatcattaatcactattgacggtctctattcgtccccagtactgatgcaggagatgatcggccactttagttgacttagggagcagctgatggacacattgtagcttgtaacctgtgacctgacctgacctgacctaccatgcgtatagctatagatgccgttgttggatactacgaatcatccctatttctatttcatgtgcttcgtatcagtatatgtgcaaataatagcgtattgaaagagtgcacttctcccattttacactaaaagattgaaacaacgaaatcaaggtatagcctgataattgatcaataaagatatatcgccaattaccgttgtcctgataagttcaataacaatgtctgagaatacgacttctgctaagggcacagcacagagcattattgctcatatgaataaagatcataaacttgcattagaggattttctttatgtatttggtaatgtgccaatcacagaccaaatcagtagcgttagattgaaagaatttgaattggaccacatgaccatattattccaacatgctgccattgattttgatattgagaaggtgattccttttgatccacctttaagcagtttcagagattccagagacagattggtgtcgatggccaaggaggctgccgagaaaagaggagtgtcgcacgttatgatcaacgagatgtcgtatcctcgagactttgtcgaatatttgataataattctagtgttcctaccaatagttgtttttatgaagagaagccttctacaatacttcccattaccgcagtatatcatcgattttatctccaaggacgccgtcttgatatcaatcatcatcggtgaaattatctgccatgcagcagagacctacttcttattgagaccgagactcaactaccatcgtgttccaacagatttccttgtggagtggtatttcttcggtatgttagaaggataccctatagtcaaacgattcgatgatcttgcataccaaagaacacattaaattgtagataaatctatatatacaattatatatacggctttcactgcaatttgataatgtagatgtaataccgtaccagcgttaatgtagcacaagatacaattcggcagctattctcccttgttctgtttttgcccttccagccggtttttctatagaagtttagggtcactattattgttgacatttaaacaactgatacatcgcaatgctacaattccaagagaaagtagaaggaaaaacagaccaaacggtcatagctcgagctgttgagtaggtatggattgcttctggaaatggttcaatcaattttgggattggctttatactgcgagcactcagaaacaattgagcattgcagttgttggtttgcaaaactcaggtaaaacgactttcaccaatctgatagctggagaggagtttgtggtcgacacgataccaactttaggagtaaacatcaaagatgtaaagctgccgaaccataccaatctaaaggtatacgatttagccggccaaacccgctttcaaaaactctgggatcgatgtttccaacaagtcgatcttttagtgttcatgattgatttatccgatttaacgaattgggaacaggcaaagaacaagcttcatgatgtgataatcgctacaaacctggagcatgtacctattctgatattaggtaacaaagtggacctaatcccgaagtttcatagagatttatacgttgccaagtcggatgtttcagatcaacggagttcagtagaaaactctgcgaggaaacagacatggaattacgtctctcccttgttacacaattatgaatacgaagatataccgaagtatgatttaaatccagaaaatcaacacgtattaagcaaggtagaggttctctcgaaagaattgggcatagacttgaagcacggattgcttcatttaccacatgactcgaaagtcaaattaaacagagacatcgccctattctcagtaagttgcaaagacggaactttgatagacaccgtcatcgattggatcctagaattatagttgtgccttgatatttaaaaagaaacctcgattcgaatatataattaagtatgaactgtcactcaaaggtatcatattatcctgctttttctattctatgttactaactttcaactttgcagcattttctccgatcttgtcattatgaaatttaaagaaaaagttgattattgaaagtattattataccaagacatattattcagaatgcaactgataagggttcaaaaggtgaagaaactactgggtaacaattgcgcttgaactgcaaagatacgcttaattcagaaagttaaagttttcccttcgataattttacgtaaccggagagttctgttaattggttattcaacgaattcaagtatttttattagggaagcaaaagccaaggagtccgatgctggagaaaacagatcctttctattataagagggtgaagttctgtctgtgtgatcactgtactgaaggttcagaggaattgcagagatacaagagtaattatagctctgacagtcgaagttctgttgattcgttactgaacggagccggcgaaaagttggttccaacggtttcttgggacacagtacctatcgagggtgtatctaacgaggaatcagggtacgacagcgatcctcataatttggattacgctctggatcgattttacgatagtgatgattcacatgacgatatacgccatggccggggatcatcaaggactcacttgggaatcaccccaacccttacagacagagtacgtggatcctcgcctatgagaccgaggcaaaacaatgatttcacatttcagcttgatgttggaggcagtagcaataatccaaagattttctttggccctaacggggaaatcagaagaagggactaccccagcagacctgttttatttaataacgcgttgatcaggacacagtaccataaggattggaagcatgagtggagacagcgagtagaaaaaatggaggagagaaaagagaccggcgtcagtacgtacttcaaatttcctgagattctatttccgaaagtgaaagtcgatttaacagatgcccctttggtcaacgacaatggggaaatgatacaaaaggaaagaagggctagcatcaaaagacatttgaaagttgttcgaacccctgttggattggtaaagacgccaagaactatccttgtgcatataagtggtagagaacatacatgggttgcactagattgggctatggccgaattggctgaggacattgattatatagttattattgcaaatattcccagaagagattggtcgactagaagtggttcttatacgagatcgaggtcagcatcgagatctcgctctcgttctagatctaggatgagatctgtctctcggactcgggaattcggtaccgatgatgatcaacctgatgctacttggtgtgacggttgcacggttggggaagtaaatgacttgcttcagcggctcatcgaatattctactttgatcatgggtggtaagaagctcaaaataacagttgaaattgtgatcggttcgacttcgcaaatattgattgattcattaaatgcgtacgctccagatttttttgtcatcggcagttctattgataaatatggctcgggatcagttgttgtgcataagtcaagacatttggctccggtgctgatgcagtatttccctattcccgttttttttgtggctgcaaggaggatgggatggttcgaaaagaagttgcagcgagatattctattcaaacaacgagtcttaccgtcagataaggacactgatctggatgtctcatcattcagtgtttccacaacggaaactgatgacactgaaaacgaagacaccgatgatgatgatgatgtggagacaacatcaaatttgtctttaggcaacagagaaaaaactgtaaagcaaattcaaaagctaagacacaattaccgttgtcttgttgacaaaaagcttaaattattggatgaagatacgggacttccaacacctgaacaatattatgggaaaatggattctatcattaatgctactttgaacttcaacaaagagctcgaaacctggggtgactctgccgatatggctgagatcaaaagaagtataacaggtggtgtacggcccagagtcatgaagaagaaatctatgcttgatttctcggatcttcctcccaagagaaaatcaaaaattccaactgaacatgagaactcaaaggaaacaatggacttcaatcaaaatactttcaagaataaaaaattacccaaagttgtgttaagctcacctcctccatcccgaccagtatccccactcgctaacaatggagagggaggtatcaagtttgctaactcagtgaaatcaaaggatggaaagggagctattcagcgcatcaagtcttatgatccatattcgcagaattctgatccatttgatagagaagattctgcgctatcattgagcgtggtaagatctcatcaacccaagtcggattcaacttcgttgaggaaagtattgagtacaacttctctagataagaaagagtcgaaaaaaggtagacttctttcatttttatttgggggaggctccaataacaacattggttctaatagctcaaattcaagtccagtggtcagcgaaagcaactcaaggagaggtagtattgccagtcaatcttcaagtgattcgactaaaaaaaggagaagcatatttggtttaaaaaaatagctcccaaattgaattactaaaaccctttaacagctagactgttattctaactcattctatttttcatttagttcttagaggataatcatgtatataaagtaatcgaaattgcccgttaggcctactattaactgccagttacacaatttaattttaatgtcacatttaagacttgaagttagcttgcaaacgaaaattataagacaggaactgcaacttcgtcagattttgtatcgttcgagagttccagagcgacaatttaaaacgatacagcctatattaatctgatcctatgctgatatttacgtatccagccaaaattattttggtgacgtttgaactgaagataggccactggtgtttgtcatttaacatccctgttttaacgtgttttcacataatatgatttaaaagaaaatgaaaacgcgaaacaagtagtcgtcatcggaagcaatgagaagcaagaaaccacaagctcaaaatgtcatcaagacctgatctaaagttttctgatattgcagaggagcgaggattctacaagaggtttttacaacttcctcaaaggagtcagaatactattagattagttgacaaatccgattattacattgtggttggtgatgatgcgttatttgtggcagatcaagtataccatacatcatcagtattgaaagattgcaagatcgatcctagcacacttcgccaatttgatttacaggaaccattgaaatatgtgaccatgtctattcaaatagtgggcaatcttttgaagacatcactattggaactaggcaaaaagatcgaaatctacgatagaaactggaaacttttgaaaacagcttcaccaggtaacctcgaacaagtagatgatttaatagtagggtcagtggaaacgaacatcgttttagcaagtttgaaattaaattttaatggtactgctgcatcaaattattgcacaattggtgtttcatttgttgacaacacgaactacagaattgggttatttgatctactagacaacgaggttttctctaacttagaaagttgtttaattcaacttggtataaaggaatgtctaattccagatttgcgtgataatcctagtatggcaaatgatttaaagaagatattgagcgtcattgatcgctgttcttgtgtcgcatcctttgttaagcctagcgactttaacggaaaagacgttgaagccgatttagcaaagctttgcggtgatgaattatccttatcagtgtcaaagttttctgcaaactgtctaggtgcatgtagtgtcttattgaactacctaaacataatgaataacgaggccaacgttggaaactttgaagttgtggatcactctctttcgcaatttgtaaagttagatgcttctgcaatcaaagcactaaatgtgttccccacaggctcacagggtaatactgctcttttaagcgtcggctctcctcaaaaatgttcaagtcttttccagttgttgaatagatgtaaaactaattccggcgtaaggttgttgaacgagtggctgaagcaacccttgaccgacatcgaccagattaccaaaaggcatgatctagttgaatttttcatggatcagttagaattaagatcttctctacaagaagaatgcttacctagtgttccagatatccgcagactaacaaagaaacttcaaaaaaatgggaacttagaagatgttctcaagatttatcagtttgcacaaatggttccagttatttcagatctgttgaaacagaagaccgaagaggttgattctaatgatttaatgatactcgtgaaagaggttttactcgatccaatgttagaaaatgcaaatcctcttgagaaattgaaagagttggtagagaccactgttgatctagaagcttacgaggaaacaaatgaattcatgatcaaagtcgaatttaatgaacaattatctatcattagaactcatcttgatgaattaaaagatgctataagaacaatacacttagacactgctgatgatttgggcttcgatccagaaaagaaattgaaactagaaaaccaccatttacatggatggtgtatgcgattaacacgtaatgatgcaaaggccctacgtcaacataagaaatacattgagttgtccactgtaaaggctggtatattcttttcaacaaaagaactaaaaaatattgccgaagagacctcagaactacaaaaaaaatatgaacaacagcaagcatcgttagtcaaagaaattgtttcgattactctaagctatacaccggttttagagaagctttctgttgtaactgctcaactagacattctttgttcattcgcgcaagtatcttcatatgcgccaattccctatgttcgtccgaagatgtatccattgaacgatcaaaacagaacaacagaacttatagcatctcgccatcccattgtagagatgcaagacgatgttaccttcatttcaaatgatgtaaaattagtacagggtgattctgaattcatagtcattactggtcctaatatgggtggtaaatccacttacatcaggcagattggtgtaatatgtctaatggctcaaattggatgctttgttccatgcgacgaggcaaaaattgctgctgttgatgccatactatgccgtgttggagctggtgattctcaattgaagggtgtctccaccttcatgatggaaatgttagaaacagcgtcaatattgaagaatgccactcacaactcactagttatcgttgatgaattaggacgtggtacaagcacatatgatggttttggactagcatggtctatttccgaacacattgccaccaacatcaattgtttcacattgtttgctacacatttccatgaactcacgacgttggctgacaagctagacaatgtttctaacatgcacgtcgttgctcatatcgaggataatggatctcataattctgatgatataacgctactatacaaagtcgaggctggtagttcagaccagtccttcggtatacatgtcgccgaagtggtccaattcccaagcaaaattgttaatatggccaaacgtaaggctgccgaattagaagatttgaagaaagataatgattctctcaaaaaggcaaagctttcacctgaggatatagtgctgggaacagaatcactcaagaagtcgttaaaagtctggtgcaaagagttgaaaaagaataaccttattgataggctagatgacccgtccgtacaagaagaatgtgtcgataaattaaaacagcaaattgacaatttggcacgagaagaagatacgacatctctgtttgtagattgggttcgtgacacactattatgatggcctgtttgtaacacttattagtaagtacagacaattaaatagcaaccaaaagtactttttgccgtgatcgtgtctgcgtctggaagttgtgttataattaggggttttaaagggagcagcagcacacacgagctattaaggtgtttttgagatatgcgccgcagcggatatcgttaccagatacttaaccgcacgccctccgctcaatgtcccagtttccctctttttcatttttttggttgtactttcagtgtttgctgagagcaatgaaatatcggtattatataataaatcatcagtatgttagcaaaggacattggtaaaataccggtatacaatattgttcgtaacggagaaacaaaaaatatttgcaatactcaattctgcgggtgttaaatattgcagatagtggaagataaatcagccaacgcaccaagcagaactttgaatgtataaatatctgctattacgggcggtgttgtcctttccattttcctgatgctgcccaattacccatcttcttggtcattgaatagatataagtaacatctaaaatctaaccgtcaaatcaggctcatcaacaatgttacatccactatccactgaaatttactttaccttcaacaatggaaacaaggtccctgcttttggactaggtactgcagctcaacatgagagggttgcggaaaccaaacaagcagtcaaagcagcaatcaaagcaggttacaggcacattgacactgcatgggcatatggtgttgaagaatacgttggtgaggctttacaagagctattcgaggaacgtgtcgttaaaagagaagatttgcacattaccagcaaagtttggcatactatgtggaatgacgttgataagtccttgaacgaatcactcgcaagattgaaggtagattatgttgacttatttctacaacattggccattatgcacgcaaaaggtgccagatccgcatggtgttgataaaatagctaaggaacctgttgatgatcaaggcaatcccctatacgatgaaaagggtgattggattgaaacttacaagcagatcgagaagatttacttggataagaatgataaaagagtgcgtgccattggtgtaagtaacttcccaattgaatacttgaagagggtcttgaaggagtgtagaacagttcccgcatgcaatcaagttgaactacaccctcaccttcctcaacgtgaactatgtgagttctgtagtgaacacaaaatcttagtgactgcctattcaccattgggagggaatggtgctcctttactagaacttccaatcctaaaggggttatgtgagaagtacaatgcctctcctaatgatatcttgacatcttaccatctaagacaaggcactattgttattcctaggtcattaaattcaacaaggattgccagcaatttagaatttgttccactttcagaagaagatgtgaataagttgaatgaatttggtcagaagaataagaagagatatatcaatggcgcagtcagttcggtgattccaggtttcaaggaagattttctcaaagagcagctgcagcagtcttaaatctctaaccgccgtatggtgtcgttgaacatcgtaataagagctctcagagccacctatattcggttatatattactaaaaaaacctatttttatgggaagcgatataactattctatactttgtagctatggcttacctatttaatgaacttatgtcctcgaataaagttgttggatgaacatagctagcatcagaattgtttctaccacttgaattcataaatgattcctgactgagaaacctcatatcaggtggaaaccacctttcattaaagttaaatcccaagtcgtagttcctagagttagtcaaattgtttttgccgtcagagttttttgcattttccaggataccttttggcatcttggcagtatcttcttgtttagttacttgcttttgagactctttatcccaccatgatcggagcatctcttcagtagagtcgtctgccaggccgaatggtttcaatagagcccaagtaggcatctttccggcattagaagatatactcgattccttgcttaatgatgatctttctttattgaaaactgcagtaattttttcagtttctttaccaatggtaacagaaatctccttcataaccaattgataacggtcactatccaaaggatacgtgcaagctagggcatttttgtttttataatgcatggtgcccatttctaattggaatgataaaaggaaaattgatacgagccatttaatattttgttgaaggtgaagctctgttatagaagtgccattcgtcactctataataaagatcttttaacatacaaagcaattcaaaagcggcagatgaatcaacattattgatcacatagaatgatgctgataagacaactagtagtaaatcaaagaagacatgctgcttgtgaagaagaatggtgtagtctttgaaatcgatagctttagatgctttcaaggttgctttaaatgaatgtaatttgttgacctcaaagtattttgataactcttcacaatctggtctgagcccaccaccaacaatatcccaattatcatcaaagaatgctcgtgtgaagttggcgagaataatgaataaagtctctctttttatatttatttcagtcattagaacactcattaatttgaagttcgcaattttctgactttctgctagttcatgatatattctggccaaaaaggttctttgattatcaagccttaagtaaagaggaatgttgtttgagtatgtaatcaaatcatctttgatttcattgatcttcgcaacaatttcatcaaatgtcataacacttgtaacgtccacagaaaataggtatctagtgatcttgtttgaaattttgcataaacacgctctaaagtagtttaaaatgacaggaaaataccatgggtttattttcacccaaccaactaccatcgattcatctttcatggcatccacaacattggcatcaggagagcgacttatagggcattccgctttcaaagttttaaaatagtttctcccgaatgatactgacatatcagattcatcaataattggaggtttccccaatgtcatcgatagatttgagtcatttaagtaacaatagagccatatcgatcttatttgtaagaaatcttctcttggcaggtgattaaagttatccaagtagcaaagttcaagatctcttgcaaatttcacagctacaacgaaaatgttcaatgcagcttccgttgaaacgcaggatctgatatacgagtagagtagtaagagagcttgaactgaaagaaggccctcacatactaaagaaattttatggtagtagaaaagactgttttgataacagtcattttcaatttggaaaagcttttccggagtaaaatcaagcttatcctttctataatggttagattccattaaagaatgtctagcatacaacgaacctaaggatagcagaatgttgacaatcaaatgttccgaatatgatatttcttcagctttggaagaaaaatacttctcaaaaattttctgacatgcctttggttcaatgacattcaagtcctctgccgataataggctatagtaagtctccataattctttgacacctaatcgagtccggaattggaagcaattgagattcgtcggatatattttttaccaaacgtttcatttgaatgaaataccatcttgaaaccatagctttcacaggaactaaaggtcgcaggtattcatccttgctaatctctggacaaacttttgttctaagccatagtaatgtggattcggtatattggcacgagttatatctttttggagttgcatgaacttcgctgttcctgcctttggcctcttcagttttaagcgattgttcagacttatttatgaagagttcgcattgtcttccaatccaatccaatctagtgcaataatccattagcaaagtcattttccttcctagaatatcaattttattatccaagacggatagttgtccctgagtgaccatcccttccaaagaagaattacctacgggatcattatgatgatcacgatgcttttgaggatttgtaatattttgagtcgcattagtagttgctttttgctgctgattttgtcgatcatgttcggtgttatctcgctgttgatttcgttgtcgtggaagctgttgcaatggctgatttaaagagtgattcactggtgggggaacaactggatgctggtgctgcgaaagaggctgtggttggtattgattatgctgtggcagaagaacagagttctggacaatagaaacagggatcatgtcaatatgacctggttgagaagtataaccatttgtgggcgtgttgttaaatggcaaaggagtctggtagatggaattcaccggcacagagttgggataatgaacgaacactgagttttgttcgagtgaaggagaagaagtagaagtttgatcgtttgaatttgataaaagattattcggcaggacagcttcgcttagattattattagtcatagggacagttgagaggttctcgatcatagtgtttctctgaattccgttagaattagccttctgtttgagacttataggattgactattattccgggattgtatgcattgctagcattagacgtagacggtgtacttttgttattatgattattattttcgctgttagtatcatttttagtgtcaatctggctactgttattattgtccgtatcgacactcccattggcattagtgctattattctgattattattactattagtattatcattattatcattattggtaatactgtgtaattcgcttttagtagtatcggaactgaatttcgtgattctgcttttggctttggaattcgtcctgcgtatcatttcttcatggtaatggaaggtgcatggaactttatatttgatacagttcgaacatttcccagatacagggtctaagtcatcacatttgatcttccgtcttcgacacctgtcacaggccttcgaaacccttttcttggcgggtttggtggtgacgccctcggcatgagaagttatagctggaataccagcatcctcagtaatgctacggatcatagtttctgaagagaaatgtgtgatttacaccggtttcctcacacctttattgaagttataactgcaatatgatatctgagtagcaattacaagttctctgtaatcgtggaaagtgaaaatggaggaagtactgaatctttcttacacttcaatatagtaataatattcgattttcctttagaaagtctggaagaaaaactcttgcgggctgtaaaatgacctaaaaaagcagataatttaaaccagaaacactctgtcaatctgaaagagttctctccttctcaatatatccccaaaaagacaaaacgaatatagtatatccagattctcaactctgtcttattgatttcctaagagataggtttgaagtgttgatataaacggataataaatcagtacataaatatttcacgacgttcacgattgacggacgattcacagagttgggctgagtgaaaaaggtagcaagataaaaaagaaaacaatcggcaaaaatgctccactagaaaatcagagggggtttccacaggaagtaacacaacaggacgggatagaaaaacacctacagtagtgaggggataggagggattcgaagcgttatgaagcgaactggcctagagacggaaatgcaagggaaaagttttcttgtggtttcccttttgttgccgtgtctttttcttcaagcgcaaggttcatgcaataaacaatgaacaatagagaatgagtaaggaatttttatacacattgttaaagctactactgttaactggatgatatcttaaatattttctgattgctatgctaccagaagtaagttaggattcaaaaatggataactacctcaaaagaaaaaaagaacaaaccatttatctgagctttgaccctgataacgcagggaccgaccgtttaagtctgcttattcattcttggtttcgaaccatttttctggctctattaaataagaaaaatgggatggaacatcgtgaaaagcgttcaatccacctacagtaacccaggacagtggtaattgggaaagtacttacaggttgcgtaattaacaatggggcgatatccctcttgcactctttttacagcgatatagtagaacattttcttgttcttctctgcgtctgtttgcttacgaaacgcgaaggcaatttgttccgagttgggaaaatagaaataaaaaaaaaagaaaacaatggttcaatcctttcccagtttccccgccagtaccgcgtgaagagaacgaaatatgtagaaacaagtcacgtgaccaagtagatattcggtggggaaatccaagcgatatatagatgcactgagcaattttatctcagttgacttgggccatgaggatggagccatcaatgttttcgggtaaaaatagaagtcccgtggacactattgcaatctcaccgtcttattccgatgcagatctctcaaataggtcaaatgcttcttaagtgcaaataacttttgtagaaagaagtcgtcgcatttcctcccagcttagtccgctcctaacgtacggtaacgtcttgttgctgctttatcggtttttctgtttatccgcgtttagaatatggacacggggttcaggttgttccgctagcggatataactcggccggtggtatccaacacttcttccgggtaagaaattactagtggaaaaatacttggctaactcatagaaccgctgatgaaaggataagcgacaaaccagagtctcgacatcatgaggttctgtgcaacgtttctctctgtctttgatcccaattttatcttctctcacattaccaaatctgggtcactattgttgcagtaaaatgaaagacatctttaatgtgtaaaatatactgccagcagcgggtttgatttggtatattagatatataaatatatgtattatataacgatcattggtttgtgaactgattttatagacatgataacttttgtctataataacgtaaaggtgaatagaaactgtatttgtgcacctttgtggcccagattatcagctggtaaagagcttcggtgcccattgttcagttgccccgctcttctaagactaggaagttatgggattaattaagcttttgaaagggttttcattgcagagcgaagcggattcttctgctactgtagagaagatcaaggaggctattgatgtttgtgattcaagtgagtgcactggtgattgtgtcaatgaagacgcagatgaaaaagatgcattacaaaaagatgagggaatctttgcgaagttgaaaattgaccatgaacaacctttgtatggatcttcaacgacttctaaaatacattttatcattccgacatctcaaactgattgggcgcatgatgcttgtatggaaaagccaggatccgttcaagctgtgatgcaaaaatggatcaatgctaatagtgacaagtactctgatattgaaagtgaaggtgagaccattcgttgttcagtatcatctctaccgattgatttgttggatattgatgtcatgaagaatacaaagaatgatgttcttatctttccgcatttcttaaagataaaagcagtgaaatcagatcttgttgctgagcttcttaatgaagttgtaccattacttttgaagaatgaacgtggaacactactagcgaaagattacattgaagaaattaaagacaactcgttcatccttttatgttctcatagaactagagataagagatgtggtatcacagctcctattctagaaaaacactttaacaaacatctacaacgccatcatctttacagagataactcagacttcagacctggtggttgtcgtgtggcttatgttaatcatgtcggtggccacaaatttgctgcgaatgttatcatctatttgaagaagacccatcaattaatatggttaggaagagtaactccgttgcacgcagaaccactaattgagtgcctaattgtaccgaacgaaccaaaattgccataccccgaaaaagttcgttgcgtggctaagtataaattttgattcgtctccaaagcatacactattcacctaagtgtattggaaattttttctagcagcaggagatgtatcgtcgatggcataagactccattcttaaatttcactgatctgctagttcggtttcgtccagcacttatatatttatatagaaaagaatagaaaccattctttaagtctctcattcgtgtaaaaaagttgcacattcttgccatatttatcacggaacaggaatgtgatgatgcttaacttctataactcatcttgctctaatggctcttcattattaagttcagatattttgttcaagatcatatatctcagcattaaatcctttggaacatctttgagatccttcatctcattttcaatatcggctatcttctcagcgcaatttgtttcatcgttcatcttaaggaaatattctctgccatcttcgcataattcgtctttatccgagcagttatcattcacaatcagttgtaatacacgatcccactggtctgaagttaccactgcttgcacaaacctttcaaatacatccaaattccttctaccattgaacgttacaatcctgtcggtatccaaagtccacgtcagatcataacccgcgttggtaattgtatcaagtaaacgatcaatccagcctctagggtcttccagacgcgtcacatttagttcggatctcaatggtttgataatttctaccgctggaaatccgtccaagcgtttacatagcatgttaccaaataattcacaatcaacctcaaagaaggcaaaattaatacctgatgttaaggcaggatcaacaatatcaacttccgacaaaacggagctttcactcaactgttcgaacaccggctttagtttcttacaatgtgagcaccaattggtataatatttaaccactgtgtacgtagggttggtagcattgaaattgttgacaactccataaaactggtctaacgacgtcacggattcaactattgcgagggcaacggttgcaatcagagatagacataagaggatcttcatacttgagttttagaagaattccatatggtttggttgtatctagtagggaattcgaaccatcatctaagaagccctttatttgattgaaccacttcttcaaatcaaggtattttatttaatcttttttttttttatggaagttgtatttctaagcacgagttaattagaaagtgtgaatgggtatatgtttatatacttagattctcttatccaaaatagttctggcacaaaacatgtagtatgttgaacgtgagatacacatgagcaatgcacaagtgaaagatgtgaaacactatttattaagatgcagagtcatgtctagaaatcgtatataaaatgtctataatgtaaaaagccctgttctcttcttaccgaatgggtatataaataatgttgatgcaaataatccgacagagataccaattgaaacttgaatcatcgtgacaccgaaagacatggatccagaaagatcgtcttgaacgacagtagtagtactattgttcacgatggcattggcactttgtacacctgctaatagagagctttgagatgcaacaccacttggcacttgaacgaagatagctggcaacatggcagaaacagcaaaccctttccagattcttgagtataagttacctaatataccaataacgaacgccgccatagcagatgtgaattctgttgaatttgcaaaatgcttaccagaaaagtacgtcacaacataaccacaacatgagatgagtgtcatgacaggcaactgcgtccacctagcttggttaatcaaacccaaaccgattgaaaagcaaggaacaaagatgaatctaaaccatggggaaatgttctttgaacacgaggtttcgttggtggcatcatggtagatccaaccaaacaatgcagctcccaatgtaataccaaaacctaaaaataaggagtagatgatggcgtagaacattctgacagcaccggcaaccaaatttctactttgaagttccaacgaaccacataaaatgatataaccaggcaaaattaaagccaatgaaccttgaacagtggcaccgaaacaaatattggagtttggaatagaacccaacgctctaccgcaaaaactgacgacaatggaggcagtcacttcaaacacattggagtaaagatttgatttttgggatacaatgaactgcaaggaaccaacacaaagcccgataccaaacgcgactgccatattaatccaatctccaccgaatgcaaatggtgtaaccattgacgagcagaatgcatacaacagaactgagacccatggtggatacaaattcttaccagtcagaattctgtcaatttccatattggcatcctcaacgctcataatatcatgaacaacttgtttataaactgaatggacaccatgtaatttccataagttaagaccttgattgcatcttaccaattgcacttcagatgttctggtagtcatatcaccgaaagaaatgatcatacacccaggcacataaaggaattgaccgtcaatctctaagacacgagaggtcattaccatatactcttccaatctatgggtaggggcaccgtacaacatcaatgctttacagagacgtagaataaatctttgcctttgcaacaagtccgcaatatgaacggtgattctggcttcagctgcagcctttttcttgaagtttttggctttcactaagttcttagcggccgctttgggtctagtagctttaaaatttggtaaattcatagaagaaccagatttgttagcgccagaaacgttagtttgagatttactatgcttatgaaatggattgtaaatctttttccccgttttttgatcggattttccagcttgatccacaggctctggggtttgttctatcgaggaatcatttaaggagagctgagactttgtgtactgatcgtcttgattttggtatagttttagtaaggatcccaaaacaccacctctaactctatctactggtgcaatgtaggagccttcaatccctaaaggctccagatcatcaggatcatctatatcatcgtagtggttggttgcaggaacatagaaagcatcatcttggtgagaagataccatagtctccccgtccgttgactgattaaatggtgatacaggttcaaaaggagaggtaacacccgcttctgttccgagattgtgttctccattgggatgttctgatgatgcacttccagaggctccatgttgtgtaccaggtgctgacttaccagccatcatagaatgtgcttgaactatctgctgggcggtagccgcgatatctgacattggaatagggtcttcaagattgttctggcctgcattacgttcatgatcattttctcccgatgggtcagtgttattgacagctggagtcaatccacctcctgttaagcttaagaacttggaaaggaatccgccatcttccacttcgtcatcagctccattcaaattcctcattccaccttttgaatgagattcagcggaatttcgaccatcattagtttcttgatgtgggcgagcagttgatcttctcctgaatagatgtctaaaatgatccatcttactttcagaagactgggtggaaactgaatcatcctgatcctctttttcagcatccttctcctcatagtattctccaccgtcttgagttgcggtatcttcaggaatgatacttgggtgtgatttgaactgaagtttcttcgtaactcctgatgttcttggtgaaatatcagctggattctcaccagaatctttttgctcttgatgttcttcctcctcctcatcatcatcatcgaaacacctggcagctcctgaattatctctgatggtagctatcgcatcatcttcgatcatctgttgtctacgattgccagactctgtattggatgcagttctgggtgaatatcttgcgtcagaggaaccgacgtttgtcctgtttgccctgtttaattcatctgtggaccctccggagggtctaaaactgggtaaattcagctgagagctagacacgtaattcgaacttggtcctgcttcatcctcacttgaacttgagtcgtcagctcttctctcagatctattcgaaggctgctgtggcttcttacggagtaaattgaatccaaacttttcatgattgttcttgtcaccattgtttccataggatgacgacattacggattgttctgtattatttctgggatttcactcgtcaattctattgcatttgaccgctgctgagacggatacaccataaaatgggagagtataaatcaattttgatcttaaagatcccttctatatatatatatatgtattaatatatgatacataattccacacatttaacaatatttttattactatgtcattgaagaatgtgaggactgtacagattacgtacggcttttgcttcaaaagattatgaatttataattggaaaaaaaaaaacgttgaagattcatactctattcgaaccatctacggttactttattggctgtgcaaccataaagaaactacaatcaaaaaaatcaagatgagatgaggagccggatcagggcagatgaaccatgaaccgatccagcaactaaattgcatcaacacaggcgccaaaaaatatatattaatctattctattgtctaacttctacttatgcttgcggtaatcgaaatcacacactaacacccaggctgcagtcgttgaaaggatcaaatgacgttaacgttactgacttttgaattattatctcctttaagtatttccggtttgtagctgtctctggttgctaccagcctattctcactgagcgttgctgtcagtcgagattttttaattgttttgcaattgatttcttttccgcagtgtaatcgtttcagtggtaacatagaagaagctgagagtacactatgatttgctttttccgcaatgtcgttttttttttcttttcgttttttttttcgtgtaaccactcatgacgtaaggaacaagaatcactatgaaacagggaagaaaagcgtggacattagttacagatgccagggacgtcgagtgtcaaaggagccaaagtttacacaaggtataaatagaaactccattaaaagacgttatgtgatctagtcacgtgactacaagaccccttcacaaatcaaaacttaaatcaccatacttcgtatgctttgtgctgaatgggccatacatagcaaattgactactggtggaagaaggtgcatagctgaaaactgctgaaatgagactataggtaaatggaatatagtgaaagcttgacattacgaggctggacatcccgatatcaattaatagacctttactcttttgggaaagggagaaaattgaataggtttagtggcaatggcggttaaaatccctaaatgaaggtagggaaggaggcttatcttgcagacaagaaaatacattgtagagcagggaaacttaatacattttttgctccttcggattcagatgcccaaataagtctggaaagatgacatatcactttaaaataccatatcgatacgtaactgtgcattcttttataggttactatcgtgtatagtagttttatagatcatggttctccattatgttggtacggagaagcagtgagtaacttaaggaagtaatttgtcatgcgcgatgcatcgatcttccagcatttttgtgctttaagttcattagttagcctgtaaatcaaattcttagtgtattaatccagaggaatcttctcactttgcaggttacggaagagaagttcattcattgtgagcacctcgactaggattaaacggtgaatccaaaggtgatttgcaacagaatcctaatttaccgatgcatagcagtcatgcgtcgtccaataattaacatattgtcgtacttcatccaatttacacataaatgattcatttactgccataaggggggcagggcgtttctactgaagctattaaaggaaattcggtattatctatatcggtaagtttagccgccatattttcttgaaaaattttcctttcagttgttgtagccaaactgtggggaagggagaactatggtcagaagcgatcgcaatgtttaccactcacatcatgacgtgcaataggtgcgccatattgggtcatatataaattactagtatacttaaatttttgtcggtacttcttagcagaatctctagtgggccccaatcttttcggcgcttacactgcagaattcggcaaatgctgcattttcggtaaatgtgcctgtacttaacccctttatatccaaattattcgattgatctattaatacataggttagtatgtacatatcttccgctcccatcctgtcccgtttaattcccgtagccaatcttgccgaacctttcttccccttaatctaactctctagaagttgttcgtgcccggtaatatttggaggggtacaatccgatcattttaaagtatatggagaatcaattaataaattagatttttaatggtttgtatattgagtttcccttatcgtagactcacccctcccctataccgctatacatggatttatcgccttgtacaggaacacttatcagcttgtagatctggatttttttttttattgctgaaaagaagaatacatcctttgcaccagaattaggcgccgacatgttggaattcttttgtggaatatataaaggatgcgttattcaaaggatctcctttaattttgaatctttttgtgttctcatcttctaattaccgtattgctgtcagttatgtgtatctttttaagttatgtatcaattgtgaacgaaggaaaccacatgcatatttgcagcagaaggaacaaatttcacacttacttttactaggatcgatagtggctaactgaagctcctgttgttctgttttgaagttttacattgaaaaagtgttttagtatataacaactagacacagcatcgccttttcactttttgagatcaaaggtattatcgttgtttgagtttcattttgaaactgcatattaagagagtgttaatatatcaggattattgtttttctgtttttctatttttctcgattctatcctatacagcattatctaaggtgtcagatttcagagatttcagacattcgataaattttttttttctaaaaaagttagaataaagagagcggtacaaaaaggcaaaaacggcactcagaagacacaaaacgaaacactccaataggtgtcagttttaggaatcctgtaataaaagccgacacaaaaaaagcataagattagttataaaatcaaccaaaaaaaaagtgcttctaatttattaccgcgtaattgaatcttaaaacacaagattaatcgttacattttaaaataaaattcactagaatatttgtcaatcaactacttcaataaagcaaagaagaacaaaatgccagctttaactttgaccacagcagattccttcatacccccagatgttaataaccctccattctatattccgctcaagaatatcgatgctagatataacgtaattcaggaattggggaaaggatccttcggatctgtgacattggccgagacaatgtacgatatgaacagttcagccacccaaatttcctcaatgtacccagaaactttgatggatcaaactcttatcagaaacgtcgaacaagaaaactggtactataagaaaaagggtatagtggcaatcaaaacaatgatgaatagattaccaacattgcatgactatacaagagtcagagagatcaaattcatattgcaaattcctgcacacaaaaatttggttaccatatacgagatgttcattgatgattctttgtatcaccttcacattgtaatggaatgcatggagcagaacatttatcaattgatgaaacataggaaaagaagagtgttttccctacctactttgaggtcgatattattccaaatattagcaggaattaaacatattcatgatcacgattttttccatagagatatcaaaccggagaatatcttgatatcgccatctcataggtacttcagcaagaaatggttggaagatgataattattcggataattacgtggtgaaattggctgattacggtttggcaagacatgtgaataacagatcaccttataccacctatgtgtcgacccgttggtataggtcaccagaaattcttcttagaaaaggatactattccaaaccgttggatatttgggcgtatggttgtgttgttgtcgaactagccaccttttcaccactatttcccggttctgacgaaaccgatcaaatatggaggattctagatttattgggctccccagatcattctatcaatggaaaggagcactttgggggttcatggctggattcaaaaccattataccaagctttgaactatgaattcccatacgtagaagggaaaacgataagggatgttctaccaaacccacaattggaagatctatatgatgtggttacatcttgcctaaagtggaatccaagtgaaagggctactgcaaacgaaatatgtgcattgccatacttcaaggaatacgtgatgagagaagcatctttggcaaagacaaataacggaaccgcatccaaaaataaggataatacagctttggcaaataaacttgcagcaaatccatcaatatcaaaccaatggagtcgtattctttctggactaccacataacccggaattgggcattgttcctagttttaactctccacagaagttaccaaaggttcaaaagaacaatcaaatgaattgtgtaacagataaaagccaacagcaaccgcgaagaggaggagttgcctcatggttcaaattttccacgcagaaaaaccacgttaacatcaatccaaatacaaacaatgatgagaaaatccttactagtgttaacacgaatacaaatagccagaagaatcaaggaattgtagaaaaaaaacagcaggaacaacaggtaaatgctcacaacgagaggctagatagctctacaaacgctaatggtaacagtattcctgatataaatctcataggacatgccaacaatgataatgaggtattcactattgagctggatgatagcatggagactatgacaggatctgatcaaatttctaaggaattaaatgacaaaatagagctttatcaagacaccacaaatcagatgaacccaccaactctggatgttgatgacgatgacgatgaacatgattcgattgacatggaccatgagaattataggattcaggtgttggacgaatttgatactgatgagaacttggaacatgaaattagagcgaccgacaaagatgaaaacaatgaagttgccgttgataagatgaagatctccaatcaaggagaagacgaagatgatgcagatagtcttctaaactattatcaggatatgatggctaagaaattaccacttaacaaaaacaaaggtaattacatgcattcgaatggaccagcgggtcctacactatcagatcaaatggcaatagacgattcacttgatctacaagaacagatcccaagaaatctgctggagagggcagtacagcaaagagttttagattgtcttttagatccatcggaacatgcatctcaaaacctgattcaaacctctaactcccacaatcatacattccaagatggattaagtttctgatcgtagaacaaagaacagcaggctgttcctctctttcagttctactcgttgaaatttctttcaacaacgctttacctggtcctcttcccattcatttataccgtttataatatccacacacacacacacacatattcaccttttgtacctgctagctcataagttttaacataacttgcttctattatttcctttataacttgttggatacaggacagaaatgccgacaactctttcactctataacatggtacttctacttgatttacctcttatgtacactattatccttactgtctttgtttactatctcaagttttttttttttttcttggtaaactgttcctatcagctccgaggtccgatgattcaaaatctttcgagccatcaactttacattgtacttcaaagtctttataaagaagaacttcggttaagaaagaacatagataatatattcaactatacagctttcctcacattagacaggcagcgaaccggaaatgtccaattatgatgttgtcattgttggcgcgggtatatttggattaagtactgctgtgcaattggctcgttccaaatataaagttgtggtggttgataagtttcaaattccatcgcagttaagtgcgtcctgtgattataataaaattgttagactagagtacaacgatgaagtctacgctgcactagcagtggaagcaatgggatactggcacggtgaaagtgacaaatttttgcctcgaggaatgctgcatgattgttactctcattgtggtagattgagtgcaattcaagataagaatacaagcagatatgctttcgataatgacagtttacaacttctacaaacaaagtttaataagtgtaaaactgtggaactacataaagagttaacttgtggtggtaagttccctcagttttctcatagtcaacgctacgatgagattcgttacaatccagactgtggtattggtttggctagggattcactagtgaccatgaaaaattatgctgaatcattaggcgtcgtatttcatgaaaatgatggagccgtgagtgtgtcagcgggcactgttcaatgtgaatctggcagaaaattccttggacacaaaattattgttgcatgtggtgctaatactgtatcacttctgcctatgtatggtcagatcagggctactgggttatatgtaggccatattcaactgacggacaaagaatatcaaaagttaaaggatattccagtggtcttcaacagtagcttaggatatctgttccctccagataagcacaccaggatattgaagatttgcactagtgcgatgtctgcatatgatgatatgagcaacaaatcaagagcggtctatcgggccctacagcccgatgcggcacccagtgtaccaatagaggcagtcgtgcgtataagaacagtactaggtaaatatctaccggatctagtcttcgataccaaaagaaagtcaaagttaagggatatcattgattgtaagatatgctggatcagtgacacatcaaattctgacttcattatagacatgatccccgacctgaaaaacgtgtatgtatgttgtggagactcgggacatgcttacaagtttcttcctaacatcggaagctacgtacagcagaaaatagaaggaagattagcaccaatactggcacacaagtggaggtacagggaaagtgattggaacggtacggaaatcgaatggagagtagaacccgaaaagaaagcattacaagaaatagaatggtaccaagaaagttacggcaccccaagactgtaacctttccggcaattgatattatgcagcaacagagtaatatattgcatggcaattgtggatctgttggcagtaaaccggtatttaaatataagtaataaagaaaaagaaaaagtatctacagcttggtacatgtagtagtaacacaatcttgcgttcagcgatatgttcacccacagctttgcgttaaacgaaaacggtactgctactaaccgtgcttttgcaccttgtttattgtttacaactcatcggctcttcattattcaaggtacgacatttttcaccgtttaacgacaaaattttgaaaatcaacaacattaactatctttctaaaaattgacaaacgaaggatgaataaacatgttaataaggaacgaaacgaaacgaccagcccagacatattgagtgtctaattagctctcgtcaataaggtactcgcacatatctctttcacgaagtaaccgttggcaaacttgatagaacagctgtacgaggatcagaaagggccgtttaatttttcctgttgggtttgattcagaacgtatagactgttttagctgtgctttctatacttcgatagctcggacaacaagcatactaggccctgaaaacagggatcccttttaagataaagaagggtatataagtatatcaagctgggcaagttaggacatctttattaatattaaggtaccgacttttcattcaatttcaaatattcaaatcaaataccgcaatacaagaaggaaatatacagtaaacgatgacggatggtactatagaacatgctcaggaccagtcgttaatagacgatgcctccactttgttgatgttctctaaaacatcgaattcaaacgtcaactcgagcgatgagggtaaagacgagttaaaagccgatatacatacacacaaaatgacaccaactccttccgctggaactgcaagtcaggtcggaagtcaagctggtagtcacagtgggagcgctggtgatataagtatgcatatgaatcccatgacatcaccgggccctgcatctgtggcacttatcaaagatgatgatgacgatgatcatctaaaaggcagtcccgttgacaatggtattcatcgcagcaactcaaatagcgaaaagacaaagaaaagcgggaataagaagggtatggttgcggctgctgcgttagcacaagcagctacgatgccactacctcttaaacgaaaagcagaaaacgatagaaaacctgctgcgaacaacagcgtgccaatgcctagatcaggtgccgaggaaaaatctccttcaaagcaagcaaagagcgaagataaagtggtggaacaagaagatagtttcaaagaagctgtagaggaacaaaaacttgaaaaatctgaaacggataggttttcttcggttcccgaatcttatgttgttgatccagatgctggtataataacgtgcatctgtggctatgaagatgatgatggatttactatacaatgcgaccattgtttccgttggcaacatgctatatgctatggaattgaacatgaaaaagatgccccagatgactttctgtgcaacatctgcaattctaggtttgtagatgtaaagctagcaaagaagaaacaacaagaaaggatcagaaatgctcagaataagaagcgtagacgcacggcaaatggcaacataaaagaggtgaagacaaaagaggccacgtctggtacgaaagactcacggaatccaggtacttctgaagcgacggaccatcgtatagaaccagaggccattccatccgcagatcctcttacgaacattgttttaataaatgctaaagaagcttatcctacagtgtatctccctttgacttcaaatgattacaaagataaatacgttgaacttttcgtaaaagaccacgctgatgacgactgggttataccttatcataaattaacgttcaaacctattccgattgaaattaaaccatattctgacagtaatcactcaagattgttccctggataccccaagttagctgtatacttgaagcaaggatgtgatgaaggagactacatcgatgaattcttaggagagattgatttccaaaggaaatacttagaagatccaagaaataactatagagtctggggaactgcaaaacctaaagtcattattcatccccactggccgatttatattgatgccaggttaagtggaaatttaacgagatacttgagacgatcatgcaatcccaatgttgaactagtcacaatcaaattgactaattccaataaccaggatgagataaagttcgttcttagagctctaagattcattgataaaggtgaagaacttcacatcaaatgggactgggacctgagacatccaatatggaagttaataaatcataatgagagcatagattccattgaagagccacaaaggtatcttttcatacattccatagacaccattctaggaagttgtgattgtgcctgtggaagtaatagtaaagattgttacttgctgaaaatcaaacgccattctcaatcactctatagatcagtcaaatcaaaaatgaataatcgatacaagcttaacgaaatattacacggaaacaaattgcaaaccaaaaaacagtcatctattctcagtaaattagcgcatgccacaatctcagacgcagcaagggccaatgaatttctacttaaattcaatgccgttaagctaaagatgttagaaccggtctctgacactgtacagaagaagtctttccatacgaacgctgggagtatcagagggaacaaatacagggtttcagtgacggagtccaaaaacagggttgacccccttaaagaaagtctttcattcatttcagatccttctaagttcgatgaatcacagattaaacacccagccgatcttcctattcccatacagacaataagtactgaagataaccctccaactgacaccaccataacaaatataaccgaaactatatcaaaccaaggacaaactagtgtcacttccgattctaatagcattaaaaattcgttgaagcgtggaatagacagcgttcccggcccttcgtctactatccaccaagctcagatgaaaaagaaattatcgtttgctgattataagaaaaaaatcaaacctgcttaacggatgacttccttggtatcgaaaccttcattagcacgcaaacttttttttcagttcgggatgtacctataggtagtcagcggtggtaataaacggggagagtgtacttaacaatttagcctccttctcataaaatgaacttttttttgcgagttatttaggaatttggacggtgggttcgatttgctttatcgatatatgttggaaaactagtctatacttttctattatttatttacattgtttataattaaccaagaactgactacttcttaggtattctctcagaaaagcgtatttgccttagataaatgcttttctcttttgttgagtaagggttgggataaaacatcccaacctttgagaatttcaagttcttcttgcatagttttcttgtattgaaagttttccaaaatgggttccaactcgaatagagctggagtagctttagaggacttcttagaaccagatcttaacccagattttaaaactctaccttgtctccaagaatctgtccaatagatggctgcagcattctcgtttgtcattcctacttgctttttgaggccactcaacaaaatgtcaatgttgttagtaggggttgtagtgtagtgtgtgtagaattgatattttccctgtaggttcaaaagatacaacagaaaatctgcttgaatcacagggtccactagattgtttttaacgcacccacataaactgagtgatagcattctttgcttgctcattgctttggcaggtaaagatattccaggcgtatcatatagaaacaaccctcctttataatcactgattctgatacattcactagtgttcctggtgacacctgcctgatcacctgtcttcgcaaccttcttgggtttgcttccatccgaatgatccaagcctgcatatccagtaaatcttaaactattaacgagtgttgatttcccaacattaggcatgccgccaattagcattctataacccagtggtagtcccacagtcttcttccccggatcatttttctggagaaacttatcatacttccattttaatatatgtaagagatctttagcgccctttttgcttcttccatctatcatgatatattgttcgtccatttccttatgccatttatttaatgatgcaataatagcaggatcgcattgatcagttttggtgtaaactactagtctgtcaactttcttttctaaggacaagtaatcgaatatgaggttcctagtggctattggagcccggctgtctcgaagttcaactagaagattaagctgaggaaggagattttgagctctttgtatagctttcttttgatgtcctttgaagtcacttgttggtatattgaaatctgggaataccattcttggtacaaatgtagactgcagccgtctacctgagtatttgacacattttaccgaaacgttcatatcttccaatacagtaagtttgtgaacaactattacagttaatggagttgtcgttaatgtttatgacaaagaagtaatcagtagtttgtcaactttcttttggtgaatcatgataggtgatcattaaagcttctttcaacatgagaattactttttactgcgttcagaacaagaactttgaaaatactcgatgagctcatgaaaagaggaaaaactcaatcattgtttcagactttgcagcaacgtctagtgaacttagaacctcttgactgtacagcaatgcccttggttttactaactggttttccgagtagcggtaaaacaactgtggccaagaaactcgtcacgttactacaggaaactatcgattccaacgataaactgtcaaactattctgttgtataccattcagatgaaaccttaaacatatctcacgatgattatattgggtcaaatgaagaaagaagggcaagatctaagattatgtctgtggtgaagagagatctttctcgtcagaaagtcgtcattgttgattcgttgaattacataaaaggattccggtatcaattgcactgtgaagtgaaaaacgtgatgacaacgtattgtttgatccacacggtatgcccaatgagcaacttggttgaatggaatgagaaagagactgatttgcataaaccttgggaaagcaattttttgaatgctcttattcaaaggtatgaagaaccaaaccctcaaacaaggtgggattctccattattcactatattgacgtctcaagatgacatcagtaccctatacacagatattagtaaggcaatattcccaaccgtgttcaaaccggcaacgaatgatagagatactgagaagatcctgcaacaattaaagccaaacaatgccacgatattgaaggctgcctctcacactaactctttgcaaatacttgactccgaggccagtagtgtcataaagattataatgaaatatatgcagcaaaatgtggtcagtggtggcacttcaagaataattcttactcctgagaatactgatttaaacgatccaaactgtctttatgtcgatctctcactacaaaattgctccatgcctcaattacaaagaataaaacgtcaatttgttgcaatgaatagattaagaaacttagagcaagatagagtaaaaccgttattcgttgaatatttgaacaaacatttgaatgtctgaattcttcaactcatggcaacacttaaagcgctttgatcgacataatctttcacatgaacacttatctcacattaaaataatgaaggaaatttccttccagaataatatcatatctgtctataaactatttacagctttagtagcttcttaatattggtatgactaccatccacccggtcaagtaacttcgatagtgacgcttttaagtcatcacttatcaccaatttacttctatgaatccataacaaatgaccattatccactatatctgataaaatgactttgtcattcttgtttaataatgattttatgaagaaatcccatacgttactatcgacagcactctcacacaagcattgtttccaaaatttaaacaaagtcggccagttttcactttctaccaaagtcgttattatttcttttatcacgtcatttgttaatgatcttacctcaaattcatttgtgatgagattgacatactcgtaaagtgagttaaggttagtgttttcggtatgcattgacttaactaaaagtttgatgaccctgggatcatggacaaccttaggatcactatattgatatgactgtaaggccttgagaatccacatattcacacttatcagctggttatagcttttcgaaagtttgagatgttgaatgcaaatttcaagaaagccaattaactcctctcttgtcggctgacataatgccaattgcttaaacctaaaaaaatcattgatgaaatagtttagttctctgttaaactctttgattgtactggcatctaactgagtattttcttctatgttatttcttttggaaatgtaaagtaactggaaaaacttgaaccttgcaccccagtactcatagtctaacggaccttcggttggtgtggcttcattaaatagctttatccaattttcggcatcaagttctatatggtttggtaaacgtccgagagcagatgctataacatggtaaggctttttttcttcttttatcagttttgaagcggaatctaggtcctggattgtaagagcttccaagaacgttggtttcggagattctcccacggtagaatagtatcttttcgtatttttcatcatcaactttcttaatccaagtaaaacatcatcctcttcttccgctggtgggtttaaattgatttgcttcttgtactggtcaagctcctcaacacgacaatacaactcctccaaattcaaatcatctcttctttcctcagtcattatattgataaacagcccatcaacgttagaatctatcaaacaccagccactttcatcattctctatcttggctattttgcccaaattagttttcctgcctagacgcctttgtctctttcttagtataccactggtgaccaaaccttccgatttgggtacttcatcaaacgtttctttaataaactttattagctcatcattacagttttgaaggtgtctaaatgatttcacagtaccaattaaaacatagctagccatgctttgaattgaagtggcagaactggagtgggcagtgtcgaaaaccacaatgtccgttactgccaacttatcatttagatattttgaaatggtttctagtgaagcaggaatttctgtaggaggaaaccgtatgggtttaatgaaaggagaatttgaatcttcctccttattctctgatatgtccaaataccacggcttgctctgtcttaaggagtgtctggtggtaaaatttcgaatgaataaggtagaacccggtctataacaaagacgagccacattgttgcgaagaagtactgcgtaggatctatgcatggttaaactaatagacaagctcaacttctcgaaaccgtatgaatccaggtaactggttaaatgtatgttcctgaatttttattataattgtggagcttctgcagatcgttgaataggaaccagttaatgttcatatattttttttttccatcataaaagttacacataagataatattatatatagttacaattttacaatttttcagtaaatatgaaaagagaggaatgtgtcatgagggtgtattaaatttgttggttattgtcctcttagttccggctgaatattttcatcaggaatatcgtctttcttgagattattatcggagacattttcctcggcttcaacttccttcaaatgagatgacaacaaccttagctgctccgccatgtcgtcatgaggtgataattgtttatggccagtgactaaatcgacatcgacgttcacgtcagaatcaacactttgatttgacaggatatctctggtagccattttaagagcttccgcgactctgtctctttctcttctgtggagctgtctcttggaatcgggtacaccgacgtctaaactttcatcgtcttgcacttgttctagcgtacgtttcagatcctcggtatcgtggttttctctagactgcagagccgctgcagcggcagctgcagcagctgcgacacgtacgttagtgtcatccagattatgtatagcggaatcatcattatcactgatcgaaccaattctgttctgatatacattatgtccactatcaacatgtgattggtgttgttcctggtgttgtagttgttgctgttgctgttggtgatgatgctgaacgtcgcgttgttgaccttcgggtagttggtgttggtggtgagctggtatcgatggatgatgatggtgttgtacttgatggtggtcaccgccagtcaattgatgagcggtgggcattgcgtatacgccatccttctttcttttcaagacgaatctggccttatacgtggtaacacgtctagcgatgttacttaacattttcttatccatttcagcttcggtcaacccgtaccgttgcttgatgatatcgagaatcccggattcttccacgtactgtgccactctaaactttgccactgtattatcgtcatcgttacacaacgactctagaatagcgtcgaatttgagatcaacttgtaaaatctttggaattttactcaagacaaaccgttgcaaagaaaggtttgattccaacggatggttatgataaggttcaatcttggttaccacgaagggacccttgatagtctcctgagagtctgcaactgctgcaactgccgctgcgatagcagcagtcacagccgcatcatcatcctcatcatcgtcctcatcctccgctctaccatcttcggccaaattcgtatgaccattatggtgattcgaaccagacgacgaagaaccaccatcgccacttaaaccatgcggagaaccatcctcagacgaaccagaattgttggcgccctgatacgacaacaaaatcttgaacggacaacttttcaaatggcacgcgaaagtgaaatgtttattcttatgtgaattcttcaaaataataggacatctcgattgaaactcataatcgttaattacatcgtaccacgcctctaacgtggggaaagaccgtttctgcgcactcacaggatctggcgcagccagatccttattgatgatcgggtgcttgtattcatataacgacatcgctggattcgaaactcgccaattcacgcacaaaaaggtataccttttctgaagctctctgttatcttttaaataatcctcttcgtcacccagtgcactgcactcgctccgtttactctctgccctatctcacttagccgccgtgccttcacagaataggtacgttcttacggtattatttcgtttataccaatcgacgaaacaatgaacctttcgcctaaatccttgggcctgccggcttccctttcgtgattgttgacactttcatctcaaatcctgttcgttcgttgttatatttttttttttttcattttttttccatgtggactgacccacttgaaggcgttggtgaggttaccctggatattagtacgctgattccgggtaacacatatttcagtgaagaatgataaatggttgcacgtgatagtgattatgaaatgagtgtcacgtgatatattataattattatcattattttcttctctctgctttttcgctccagcgtccattgagacgtataatggatagtgaaaaattacaggccatcagcaagggacgcgtcttgtcagctttaataaagtggtagtatacctcaaacttctgaatataattgaacaactacagcctctgtaaaaaaggccggtatttttttcaaaccagttatcatgggtatcaaaaatttagctacacttatttctgagcaagtaccgaatgctattaagagcagagatataaagtatttccatggaagaaaagtagccatcgatgcctcgatgtctctttatcaatttctcattgctgtgagacagcaggatggggttcagctcgctggtgaagatggagaaacgacgtcgcatcttatgggtatgttctaccgtacgttgcgcatgattgatcatggaataaaaccatgttatgtgttcgatggaagtccaccagaacttaagaaatacgaattggataaacgtaaggtgagacgtgaggataccgaggctaagttgaaagaagccacggaacaggcagaaattatcaaacatgaaagaagactcgtgaaagttttgccatggcataatgaggaagctcagaagttgttatctcttatgggtattccttacgttgtggcacctgcagaagctgaggcgcaatgtgcagagcttgctaaatcagggaaagtgtttgcagctgccagtgaagatatggatacattatgctatcaaacgccagttttattgagacatttgactttcagtgaggccagaaaacttccaatccaagaatttgacactgatgtgatttacaacactttggacttgactcagacgcaattcattgatttaggtatcattctagggtgtgattattgtgaaggaatcaagggtgtaggccctgtcaatgcattgaaattgattaaagaacacggttccctggaagccatcgtagagaaattcgaaaatggagacatcagtagtggcagatggaaaatccctgaaggttggcaattcaaagaagcgcgtgatttattcatgcaaccagatgttattccaagtgaggaagtgacgttgaaatgggaggaacctaaagccgaggaattgattgaatttatggttaaagaaaaagggttcaatgaagacagaattaaatcaggtattgaaagattacgcaagggtttgaaagtcggcgtacagaaaagacttgactcattcttcaaaattcaaccgaaaactaaggaagagctagcaaccgctgctaaaaaggcaaaggatgcaaagaaaaaggctgctgctaaaggtaagattgccaagagacgttaagttttattgttttatcttaggttagactgtttacattacattaccatcaattacatagttaattcaaaatcattgaaaagttatagtaaaaaggaactgaaaattattccagttcgtcagacgttcattaaccgataatataaataaatatgggatgatattcctctaaccatgtataactagcaaggtaagtggtttattccaactgataacatacatttgtccataaatgtgtatcatatacatatatatatagaatgaaccagcgcataaactgtattgttacgagtcaatgttcgagatgttatatgtctccaaaattcaattaattgatttcaaaaactacgtaattgcctacagtgagaactatgttatatattatcgataatgtacaaatactagtatttattgcaaatgctaaaacaaaggttctttgccaacgactctgtctattaatatgcgcacggtaagtgaacaaaagaaggaagagcaaattttgttatgtgtatggaaggtgagtgctacaattagaaactgaccttatctgctgaacgaagaatgaaaatgtttactggcgtaaacgttcagagtggtacttggtttctttaactaacttgatggcaacttcttctaactttgtgatttcttcgcctctttcgaagataatgtattcgttattttcatccaatttggctttaacttcgtaatcattgatgatgttttgtgctacagccaaaaccttttcgatatcaagatcaaacaatttcgataatttagaaatggatattttagagtagaatctcttgtaagtgaaaatgtaagttttcaaagtttcaatttgaaccttttcacttagttggttgatgatatcatcagatttactcaacaaagaccacacagaaattttcctcaaatattcgatcgattgtaagtaatcacccttttgcattgactttgcagcataaagaatgtgatctcttagagtttctggaggaccatggaaaatagctttctctgaactctctagaatacggcggatagatttttggaaaactgggattctcttgaccttaataccgctgtaataagctgccatgtgaggcacatcaagtaataaagaacatgtcatgtagacggtgtcaattagatccaagttgatgtgttgatggaaaggaagacataattgttcaacaggggcaccctgcacgacattgctgttcgcattagctctttgtaaactttgttgacccaaaatttctcttagatgtggattaatacaaagaccgttcaaaacttggtgacattcatttattaaaccagccttaaatgcagccaaaccaagttgaataacacatctattgtacaaaatttgtaatgctgcatcagagcctgaaatgaatttagcaatatcggaagaaagcattattttctttgctggagcgtattcttggttcaatgcaatataatatgttttgtacaaggtaccttttctgtagttgaacacgttgttactcttttgtttaattaagaaatcggacaattcagagatgaccttgaagttgtaatcggcatctgcggaatctgattcattcaaacgaacgaaagaggattcaagggacgcagttccttcacgaatttgtttccatgcaacggtttccataatagagatgagcttgtcggacttgtagtagatatgttcaagtcttctgttgaagacacgggccaaaagtctatcgcggtgttcttctgcagttacacgttcaaagtacaattgggatctgataatcaaattgtaaatagattgttcatctctcaaacgttccatgtattcactggaacgagtgtcaatgttcaaaagggatttgctaaattcatcgtccaatctttcaaccatagagaagatagaacccaaaatttccttgacaccatgctcattagcttctggttcatcttcaatgaaatcatttcttggggcaaattcagtaacttgatagtggtcgatctcttgttccagcacttccaataaaccatccaagttatcctttgatgctttccattgttctagtggttggtatgataaggatacagatgcatcgaatctgattggaatcaagttcaagtatgtacagatcttttcatatggagtcttggcaatcttcaatagttcttcggtggttttaatttgttctgtgtggtcagtgtttttcttacctctagaatcgatgataatattcaacgtcttgaaaaagtctagctcagaaatgttatttgccacggatgccaagtctaaattcttcttaccactcaaggagaatggagtagcagagacatctcttgagtctatatcagcatctaagacaggttccttgtcaaagtcctctgggttttctctgtaagccttaacggaggtttcgttttctctgattaacttcttaactctttgcttggtggtgttataagctcttgcaactgccttattcttaatttcatcctgagaagtagcagataccgcatcttcaaatctagccaatgacttcacaaagatattaggtgtaccgtagttttgttgttgggcttttgtgtataatttcaaaatggtttccaaatggtttaataatgattcccaatcttgttgggcttctgcggaatcaattttttggtaaatagatttcatttcatccaacaacttctcttttgctgacttcacaaccttcttaccatcttcttcgtcggatgagtcttcatcagatgaatagttggtagatttcaagaacttgttagcacctgaaccaccaccttttctgaattctggcttcttgaaccagtcagggccgtagggtttgctatcagaatcattgtcttcatcattatcggaactctcatcagagtcgttgaagaaagagtcatcagataattcttcctcactggaggatgaaactaaatcctcttcactttgagataacaagtcttcttcttcaccagaagacgttgaatcgtactcatatgtcttcaaaaaaaaacgggacatgatgaatggactatcgcttaacgttgttctatttccttaataccacgtactaatctcaacctagtctccctgttacgacctggtgattccaacctacaattgaaaagtattgcttattacacgtctcaactgaatttcatctattaattcgatttcaaacctttcagattttcttttgagatgagctttcactgagtgaaaatttgtgaaaattttcaaataatcatggaacacgattggtagccgggtaatgataaatgaatgtaccattgcaaagaacaaagtgaagtgggagtctgtcgccggttgatgttaggccaaaatggacgtctaactttgtgtgattgcgtataatcatcgatgataaatagggtataaaataatatcgatttaatttagttatatgaaaagtgaaatatagatgttgctaagaaataaaataattttgaagctttcataccatatacgatgccttcttgatcgatgttttgtgggcatacttcgacaacgggatagatacatttatggttcatgaaaatgttctgctgttgtgatatataaagtactcttttaatgttcttttttttttttagtccaggaattaaaatggatagtatcgcaatttgaagaattcaagtaggtaataagttaatatcacctttagataacagccgtagtaacaagtatgaatggatcaatttgctgaaggaatgtgtgacctaaatgtgacatgaaagcttcatttgtataattttgagttgttaataggagacgaaaggaaacaacaagtcaacaattataaccggtatcaaatgagaaagtggaagggtaaaaaaaatacacacaatctgtattgtatgttaaagagaagagaagctcaactcaaaaattaagagctgaaatcacaatccaacttgaacttcaagtttctgttggcatcccaaacaccccagtacttttcaacatcggaaataccagaagtatctggtttccagtcctcatcgaaagcttcgaaaacgataacgttgacaccccagcctctcatagcacaaataccatcagcccaaaattgcttagcgttatctagacctgggtaagcactttcaaagttggtaccatcggttggccagccagtttcaccaacccagaattgaatgtcagtagaacccttggtagtttggatagtttgtagagcttgcatgatatcgtcgaagaacgagtaagaagcattatccatagtttgaccttgccagtaagagaaggcgttcgccatgacaaagtcagcagcttgaatggcggtagcagatccaccatcgaccaaaacgttccatgagtcaacagtaccgacttgcttgccactgtaagagttaccatcggaatccttgatgtctttaatgtagtccttgacatcagagatagcatctgccaattcagaagcagtcatatcttcacggtacaaagcttcggaaccaaccaagaaggcttcgatggtagaagttttgatccatggcaagtattgagtcaaagcttgcttttcttcttcgaaatgagcagaatcagttggccaaatacccaagaaaatggtaaatccggcttcttctgcagcaggacccaaaatttgtaaagtgttacaatcagaagcagcatatactttgaccttggaggtgtaacccttcaaagtttcgaaatcagctaaataatcatccttttgcttacaagaaccatcgtgggtcttaacacctaagttgaatgcaagctcaccaacagcagcaacagttgaagcaccggccaacaaagtggcagaaacgagtgtagagaaacgcatagctaattgattaataactatttgccgagtgacgttctataactaaagagaagttacaaaaaatttactgtattatgtgcttgcaaagtaacataatgtagatcaaaatgtttaatcactatgagtattatttattattatttattatatacatttttcatttttggaatattttcgtttcagttttctctcttcttagaaattaccaagcaacgtccattctttttttctctgatactaaaaatagtcaggtgggttcgagaatgtacgcacgtgattttggggttttgcttaactaaggaacaatggttgatacagatgtggatttcaatggattatataatggtatgtaaatatgctggcaatggcctgcggctgcaatgctgaattggtattggtatgagaggggagtttgtaaattagtaggttgatagcagtgtcaacgcaatcatgcatgcatcttcagtacgtagctgtccttgtggagtagagcctggtaggcttaattcaccatcgaaaaattcgaaggcaccagtggcaccttcgaattgttctttacacgattcaaaacttttcttgacatggtcccattttccgaatactgctagtaagtttgctggattcgctttggatgggtcgagttcaatttcttcttcggtcggtctaattaccttttcgatggatgggatttgagtttgtaccttgacgtttttctttagagtttcgtcaaagaaaaagtctccgctgttgatccataccgtttgggtatacccttgtggaaatggtgattgtgtgaaaagatctgcgaacgatttggcaactctgacatggtatccgaaagatgctttggctccaacgaaatcaccgtacgcttcttctggagatacgactttctgttcaattgtatccacggttactctcacatttattggaaccaactggcctttcaactcgagattcttatctttgccaatgttgatatatttcgtttgatcgaatgatttctttgattttccacgttcaccaggtttgctcattctgattgccagcccttctctatatctaccattattatcttgataaaatctcatgaacggtaaagaaggaattctaggcaattgcttagcgtaagtaaaatacttcatatagtcctttttgaacacactgttgacaaggtatggcggtgtgatgaagaactgtagcaacgaagccatcaacattggttttgaaagccttttcttcccatcttctttttcggaatcctctagatattcagttgatgcattgttggtattattcccatcatcaaacttgatctttgcaccctgttttttatcatttttgcggtctgattcgcccttgttggtctccgattctgccttcaaaattactatttctgcaacgttatatatacatgcgcttctggcgatctgatataatgtgtaggtgatttgttccaaattcttgcacgaatctaatactgtagtcggtatgcatatggaatggttgacggttttagttgacactttaaccactttcttcgctcttttgaattgagctagatgatctctcttttcagtaactttggtatctctttttacctttttataattctgtttcgattgctctttgcttcttttaacactcatggctatagattcgtcagatgctttgacactactaatgaaagttcccgtcctaatgttatgtatgtgttggcgctcttatctgaatgtagtatataacaagatgagatgagatgcgatgaggtctattcaatatcttctttctctgcgaccgctgcgagatggaaaattttcccatttgtacagaatcatccatcacgtgacttaattgattctgctcaagctcttgagtaagggggagtcatgaaggaagccaacaaaaattatcgataccaagctgatagatcaagttacatgtatgtgctagatattttgatcagatgacgaaatcaccctttcctaaacctgtgatgacagaatagctcattggaaaagtggtgaggtaaattactaaaattatacgtagtttaaagagaaaacttaattttacatgatgatttggaccgtctaataatatggaatgagaagctgaggcatacaacgaagtaaaatcattcgttcattcatcatcatcatcatccggtaggttttgcttggcattctgcaaatctgctttaacgttgtaatgtttctttctcatttcttcgaacttccgatgtttcttggcagcttcatcttcctctgtttcaagaacaggaggagaaacctgtggatcctcattgtttagcaatgtaacgggttccttgtcctctttcagatctacttgaggttcgcctaaactgaaaccccctaaatcttcatcatcgtcgtcgatcttgtaatactcaccgtttgggtcaacagcaccctggtatggagtttttggttcatcaatatgtatatcgccgaactcctgtttggtgatttcattctcttccaaattcttcttattccatttcaaactctctggatcttgttctcctaacttcatcgatagaacgtctttagggattccatgtccatggtgggctattttactattagacgtgcgcttcgcattcagttccgtattcttcaaaacttgttttctgaattgactgatggattcggattcaatattcggactctgttcctcaggaattgcgttctttaagattcctcccataatgtaaagttgatatattacaatacttatccgaggtagttaaaataataaagtaaggtatatcagacacagaagcactaaaatgacacttgttagaatatgctggtttaacctcttgtaacaaaactaaaacgcaggctcagtttgtggagtaaggtatgagacgacttcttaactatgatgaataaggcttttttttatatggtacaattttgggttcaagattttccctttttcattttcaatccaaaagtagctagtaataaatgcctgtgttagttaaagctatagcagaataaaactaatattatcactaggtggtggtcttttcggggtcaatttgtacatgcatgtgtactaaagaataactatatagtatttgattatcttttatcttatgagctcgtgacaatacagtacaggcgaataaaatgttattatttaatatggggaattgatcattaaaaggcgtccggcaatttttaatattggaaactcaaagtataattttcaatatatataaaagtaacactacgaagaacctgttccataattgcagcataatcaaatgaactgagaaatgaataccgcttttatagacgccagccaatacaagtatgtaattacacatattctatttttaaatgatcatgcaaccgttcagggctggacaaaatgaactgaagttcacatattctaaatgggagtttgatgagggcaaaagaactctttgggattttagtttgctttgaagaaataaaagcatgttaacatcagtagatctttttcttctcgtcaattgacaattgaccagcaccagtgttgccaatcaacaataaacctccaatgatacttaagttttgatagaattcgtatttcaagaaatctcttttgctagacccatagaaccaatagttgttgacggtaatgttatagaacgctagaatcaaacctaaacttatagatgcgaactttgtcttgtaaccaattgcgatacaaacagtacctgcaatcgtcaacaaaactgtcaaccaactcttagtaaaagtaaaggtaataaagagcaaaaccattagaattcttccagccaataacaagtaatttttgaatttaccatccttactgtctaattcaggtagcataccaaaggtcatcctgttggtaacaatactgtcaccaaatgctatcaataaacccccaatgacactaatgtttctcaagacaaaagatgatccggtgaacagaccgtaaaccaaaccttgtaaaatgacggtacaaatcaatgcactggtggcatacacggtttgtttcctcaagattaatagcgtggcgcctgtaaacatagagatcacaacgcaaaataagaagaaaacgacaaagtagtaaggaaaatgtctgtagttccataaataaaacacttgatctgaccattgagcaatgattctcaacgaatcctcataaaatgtggcaacaataaagaatctagcaatgattggggtgtaaggcctaattttcaagaccaatggatgttccgttaagtcttcaacccttttagcgaattgttcaaataatcgcctgtacttgtccttagctgaaacattgtgagattgtgacgcttggccatacgatgcaccttggaacccaggctttgctgttggaaacgtatccaaattgttacctctaaaagacatggctcgttcaatggtattccgcttcagtattaccaattagaattttgcgctcaaacagaaaatactatgcacaggtattacggtgagctatacttccaaaacgacacaagtaatggcagctcgcaaaataggttccaattccttagatatccactaccactgaactttcactatgttttcacacctgttctcgtttggttccagtactctgcaaaaaaaaactgatctgtcttttaggttgggtccttttttctcccacactgttattgtttttgatttttcagtactgatcaatactggacgttgaactaccgtatatatatagtataacctaaaattttcatactatttgaggtttaccacatcagtccatgtatgaagcccgatgctacgataaaccagtaagcgcttgaagtatttgttcatttctgcttgcaattcggattttacttttataccatcttaaagtcggtatttatataagcgataccactatctgactttcctggaaaccgaagtaataggtagctgtcagattttactggtatatatatataaatcgaagggttaaatagcagagccaatgtcagtagactatgttatatgctatatatttcctctgggctggttttgaactgatctcatctttaaatttataagtagtaagagacaatagcagccggtaatttcccagcgtcagtcaaagcctttgctgcatcagacaatatgtttttagcagcagcagtatcactcttgatcttttcagcaacgtcaaccaattgttcgtcgtccaaagagtcgacaatcaaaccagtttgttcctcgatggtagtggatttgtcggcatcaccaaagtaatcagcatcctttggagcgttacggatacttctcttattcttcttcttagcagccttagcagcttccttggccttctttttgtcaaccttggcagatgcggcttgagcagcgtccgcttcagccttagccttagcttcagcttcagccttggccttggcttcagcttcggctctagcaccggcttccctttcccatttctttctttccttttccttcttttcttcttccttgaattgcttgatacgtggatcttcgttcatggctctttcgactaatttcaccaaacgagcgttgtcagcagtcttcttcttatctctggccgccttgttctttctttcgatgtaacgcttgtgatctctgttggaagaatcatcaggaacttcttcatccaagaactcgaatgttctccaagagtcgaatctgtgccagaaagagtagaacttttcaacgtcttccttggaagtgttcatatcacccaaagttggtacatccttcttcttggagaaacgagcttcagattcgaaaacaggagcccaagcttcaaagaagtcgtagttagtacccttctttggcggagctacatcagcttcgaagtcacaagaatcatattgcggtctcttgttggagtcagtcaaagtttcatatgctttttgaataatcttgaagaaaccatcttggtctaagctagcaccagaggcagaagtcttatcagggtgatacttcaagacttgctttctgtgagccttaataatttgttggttagtggctctgtaacgtaacttggatagacccatagcagcgtacaagtcagcagtcttccagtctcttgcgtcgtgagttaacaaactttcgtcagctaactcagtgtcgaacaacaactcgtctggatcgacattggactgttcaacgttttgaacattcttttcagcctcaatcttctcgaactcagaccatgtgtggtttctcaaagttctttgagcgtggtgcaagaagaatttaccaactggttcaataggacgtctaatggatggtgttagtttagcaccagattcaacagtggcaccgacggcaccagataatggaggtagttcaaacattgctttgattgctgttatcggtctgacgtatgattatttgtgtctggacagaacggtataacccatcgttcatcaaaattaagaccagatataatgcacatgagaacatcttgataatttttttcttcttcctatagatgcgatgagctcgaagtaaaaataattgcgaaaaaaatcaacacattgaaaacgacgtagcttgaaatgaatagaattatctattatatataggttatttctgcctagataaaatgatacaactacgacaagcgtatgagtaacgaataacatacccttttcatattgggtctcgaatacggattggtgtaactgatgttgcttttcgaacgcagctgcaacttcaaaactaagagatttttaagttgatatagctaacgattaatagtcatcaagtactcttttcacataatgggcattatcgaagacagagtcttctaattcgatgagtccagtttctgctttatacacagaccagtgatcaattatcttttctaagatatctgggtgctctttggacaaatctgtagtctcaccagggtcttcatcaatgttgaaaagtaaccagtgaccagggccaaatgggggtggaatatacacacctttataaggaccttggcgaatggcacgttgaccaaataattcccaaccagtgaccctggtatcgtcatatattctttcggattctttttttaagaaaggaatccatgacaaacctcttggttcgtgcaccttgcgaccttcaaatgaggtacctggatgaggaacgttagccaattctaaaacactaggtaaaatgtccataactgttgtaaactggtcgatgatttgacctggttcccatagtcctgttaattgtggagcatgtaagataagaggacaattgataccaccttcagttgcccacattttatacatataatttggagcagtagctgcttgagcccacaaatcaccataataaacaaaactgtttgttttaccaatgttgtcaaaatcgttgttataatcggacgatattctttccttgaaagtggaacctccaaacggcaatgcctccattaacataccttcagcaccattgtctgacataaacatgatgacagtgttgtcgaattcatcggtttccttcaaatgatcgataactctaccgatattttggtctaattcatcaaccatcgcggcataaatttccataatacggctttcgtaggcctttcccttatcatctaattcatcccaagtcttttctctttgagtttctactaaatgagcaacaacatcagctggaacaataccaagatctctagctctttccaatctttgtcttctcaatgcctggggaccaccattatacttacctttgtattttgcgatagtctcagcaggagcctgtaatggccaatgtggagctgtgtaggtcaactggccaaagaatgggcgaccttttctttcttcatcatccttcaaatattccaaaaatttatctgtgaagtaagtggtggaataaaagttttctggaaacttgttatggtctaccctttcgccattttcctgataaatccatgggagaagaaacttgctatccaaattgcatttgaaatggtttcctgcaccaggcagcaaggtaaaacgtttttggaatccacggtcacttggccaatatggcttttctaatccaaggtgccatttccccgaaatcagcgtgtaatattctggggataatatttcaggcaatgcagcaaccttatagttcaaataaccttcataaccaggtttatccttgaacttttctggaaattgcctggcatattcagccatttggcccaaacctgccaaatggttgtcagtaccgctcaacaacatcgatctagttggcgaacatgccgatgcagtatgaaaaccagtgaatctgaaaccacctttagacaatttatcaaggtttggcgtttgtatttcacctccaaaactcgacacatctgtaaaccctaaatcatcggcgacaataattaagaaattcggctttttaggttcatctgttttggtcattgcaattcgattgtacttttctctaatgcagtttgcggattttcggatagatcatagagtaacaattggttagtataccttcacaattcctaaaagaccatgatgacaggtgagatgatccatatttatattgtaaattatgtcatttaaagctttactcgaagtgataaaaagggtgacagtaaaaaagtttcaaggtaagaactttctgtaaactctcatgatcgggtggagcgaacagtaaccggttaatttagtaataccttacacttccagagaaaagcccggtactttccagtttgcccagaatttagcagtcaaacggagtctttttgagtcttttcttccaaaatcttacaaacattatgatctagcaagaaaaacatcacaatttcatgtcctctttcttgagcggatgggcttgctgtatctattttggttatgacaacctgcaaaattaggagaagtcacgtgctattaagtttggtagcgcccaacagttcagcatcaagtgcatgtattccgtatccacagataagtaaccaaatgcctgttaatgttcacctacggcttgacaggtaatatgtgtttaattttagatgtgagatgtccccacaaatgcgttggcatgttgcatcacctgcattagcttcttacttggccacccattatgttacccggtcacttttcatggaggccctcaaatagctgaggtattgaatgtctgaaactgggaaacagcgcctaaagtaaatacgaaaagttacccgctcttttgaacaacctcaagactttcgcaataaaataccagaagaggcagtgggtctgcaataaatggagatcttcaaaattttccgataagctcaccagaactcagcgcaatggttttgtcgcttactgaaagggcacgaacagttttcaaaaaataaaaaaaaatgatatgagcttcctctgttacttccactggaaagtcacgtgacaaataccgactatttaccttcagaatcatagttaatatagttgacaaccggttcgagtagccaattccagaatttctctacctagttcctctgttcattgtcgttatgtctgatacaggttatgcatgtacaaattattatacgacagatggagtcacttgcaaacctaatacgttgacgttgatggtctcctccggaacttcggaatctgcattgaacgttacgtaaaaaattggaaaatagtctaaaaaagaatatgccaactgcaggagtatatcatatatatatttggggaggatccatacgcagttgaatagcattggattctgggaggtgtctttaaaggtttgttaacatttcgatatctcatgtgtgagtgaagtaaacttcttttagatatgtcatccgattcaatgggtgtaaagggaattgatgggcaattaacacaagctgcaatgtcaaatattgaaactatcgagttgaaaggtattaatgaacaaaggacgaggaagaacgttatcggatcagaagtaggtataaatataaatgaactacagcccgtccaaagttttgataatgatgacggaggttcagatgcctatacagattacgatgacgatggttttacgtatgctgagggagggatcgcagcttggctagttgttcttggctcatttttaggtattttacctacatgggggttgtatttttcagcaggtgtcattcaaacgtacgttgcacgtcaccagttaaaggatgagtcaacatctacagtatcgtggattttctctgtttcgagttgtttgttattagggacaagtgtcttcagtgggatgtattttgacagatatggtgctagaaaacctttagtgataggtacagtaatgaccgttgggggtgtattggcagtagcacaatgtactaaagtgtggcagtttattcttgcattgagtgtttgcgttggcacaggatcaggtattacgtctagtccgttattgggatgtatctgtcaccattttcagaagcgaagagctattgccactgcagttgccattaacggtgggagtattggtggtgttattttcccattattcttagaaaaatcgtttaaaaatttggggttcgcctggactatgagaattatggctttaatttgtggagtatgtttgactgtttcgatgtttttaatcaaggaagaccccgagaaacgtgcggctgtcgaaccgaaagatgctagcactcctttccacaagaatttactttacaacataagagattcctttgattacaagtctatagtatccgatcaaaagtatctgttttgtgttttagcttcgtgtttggctgaggtatctactggtgccgttttaacctatatcacatcttactgtacaacggtagggtattctgagaatacttcatttttacttgtcaccattttgaacaccttaagtattgtcgggggatacatgtttagttttttggctgataaagtgatgggcagatttaacgtcatgatcatgatcaatttcttgttaggatttgtcccgctaatattttggttacctttcggaaacataggtccttcggtaatgtacggattttccgcagtctatggtttgttttatgggtcattgattaatctcgctccagtctgctgcggtcaaatttcaaggacaaacgagtttggaagaaggtatgcaacaatgtattgtttcgttggtctttcatttctagttgcaattccagtctcaggtgttatcatcggtgatggttccttaaagaattataacaactttatcatctatgtttctgtattgtccatgatttctagtggtttatatacgatgagcaaatgttacgcggttaaacaaaagcttaatagatcacctagaaatgcgcacaataatacaattctatcttctgtatttgcttttgttacaaagaaattctgaacttttacatctggcttatatctaatttgcatctttccttatgttaccaatttttattccttttgagctattgtttcctctgccaattagtcaaatgtcaaccgataacaacagttcttcatgagtcattgggatataacactgaacgtattgagtcagtactagtttttactgtgattataaattttgtatatatacatattacgcaatgtcattaaaatcgttacatggatttgtggaggaagcaccgctcacccattatattgaaagaagaggaaaatagtcaactctgtgatacggccctcactttctctgtcttttaataccgtgaagctcattaggaggatctgaattggaattggaatatgttgtatttgtcaccatcttcgaatctgaacgttctgatctatctcttttaaggttgtcatctgttatttccttgataggtggtagagccggcagtttttcaggttgtaggcttctggtatacatttcagagttgatgatttgctgagtatcatcagtttcccagtcgctattatcgggttcctccaggtaccagccatatggatcgttttcatccatgttgcactgccaactaggttttcagaagtgtcttggtattgcctcaaatcacactttctgattaaacctaatcagcgaaggtagcagtaatttgctatattagaacactgttgtagggaagcatgaacgtatcacagctcaataactacacttttagggacttaatcaacgtctcaggtatttaatatgatagatacaattctacttcgttagcatctttcaaggcacttttcttttttttttacatcaaaggtgaactctggggttttttcaactatattgtatggctctttatggatctctaactacaaccttagagacaacgactacagtatcgttgaaaaatcgaataacatttatcaagtttatcatctatgtattattaagaaatatgttcgtatatacaaactttttggtgtaataccaattaagagaattattattaatttattttgattttgagattaatttgaaggataattaaattggtttgcagtgtaagtactcactccaggtacggacttcatgaggaacaataacatccttagattccaaaaccttcaccttttctgcaatcttcagactcatagctttcgcaaatagcatagcagtttgtggctcattgaataatggaagggcaaagtcaatagcatttcttctcatgatataatctacatcttctaggctctctgctctcttggcggcaagattgaatacagcactgatatccttggcttggaagagttcacgcaactttctcttgtcattttttgggaattcgattagttcgactgaaacgcccttgctgaacgtctccaaatatttcttggtatcctcattggtagcatataacttgtaacccaatggtgcaacatatttcaccacttcacctagatagttcttagataggtcacccccgaagagaataccacttggtgggagaggaacattgaaattcattgtactttgaatagcagtccagtaactctctaacgcattgctaccgaaggacgcaacctcaccggtggatgccatctcgacacctaaaaatggatcagctccggctagtctggtgaaagaaaattgtggaaccttggttgcaacatagtcatatgctttgtccattagatttacaggttcgggaacatccttgctcaaaaatgcttgaacagctgcttctatgaagttaacacctaaaacttttgagacaaatgggaaggatctggaagctctgatattacattcaatgaccttcaaggaaacaccttcatctctatcatctttgataatttgcatgttgaaaggacctgtaatattccatgcctttgcaactttgtcagcaatctctttcaatctatctttgatattttgagacagattttgtggaggtaggactaacgttgcatcaccagagtgaataccagcgttttctacgtgttcagaaatagcatgaactaataccataccattatgtgctacagcgtccacatcaatttcttgagcaccttcgatgaacttagacataacaactggatgatctggagagacgtccgaagctgtggtaagttttacttcaagttcgtgctcaccagtaacaacactcatagcagcaccagacaacacgtacgatggacgaattaaaaccgggtatcccacttgattagcgaatactttagcttcttcaacagaagacaactcactccattctggttgattgacgccgatagaatccagaatagttgagaacttgtgtctgttttcagccttgtcaatgtcttcaggagaggtacccaatatgtgagcaccattgtgaagaagtttcaaagcgatgttctgtggaagttgaccaccaacggagatgacacaaccttcagaattctccaactcgtaaatatccatgacacgctcgaaagagagttcttcgaaatacaatctgtcaacttcatcaaaatctgtggaaaccgtttcaggattgtaatttatcataatagttttcttcccttcttttctgagggcctttgtggtgttaacagcacaccaatcgaattccacacttgaacctattctgtagacacctgagccgagcactagaacaccattatcagtgaattcgatatcactcttagtagcattgtaagtagtgtataaatagtttgtttgagcagggaattctgcggctagggtgtcaattcgtttgacaaacggaacgattccaaaggattttctgtaacttctaacttctaattctgaggttcttgagtcactacccttgttcaaacatagtgcgatttgagcatcagagaaacctagtttcttcgcttcaagtagcagttctttgtccaaagattccaggtcattaacctgttccaaatctttatacatgtcgactatgttcatacacttgaataggaaccatgagtcaattttggttaattcatggaccttttccaccgaatatccttcatggatcaaagcttgtccgacagccaaccatcttctatcggtaggttcactcaaagcattgtccaaatcatcaaattcatcagacccttggaatccaatgaatgaagggtcgatttgtctgatggccttttggaaagcttcttcaaaatttctaccgattgccataacttcaccgacagatttcatagatgaaccgacggatctgttcacgtgctggaacttcgataaatcccaacgtgggatcttagcgacaatgtaatccaaagatggttcgaaatttgcaactgttgtcttggtgattgggttaggaagttcaggtaaagtgtatcctaatgcaatcttggcggcagtataagccaatggataaccggtagcttttgaggccaaagcggatgaacgagacaaacgtgcattcacttcaatgactctataatctaaactgtctggacttaaagcatattgtacgttacattcaccgatgacacccaagtgtctaataatcttgattgctgcgcttctcaacatatggaactcctcatcggatagagtttgagaaggtgcaaaaacgatagaatcacctgtatggatacctagtggatcaaaattttccatgttacacacagtaatacaatttccgacacgatctctaaccacttcgtattccacttctttccagcccttcaaagatttctcgacaagaatttgaggtgccaaagaaagagattgagaagctaattgtttcatttcttgagcgttattagcaaaaccagatcctaaaccaccaagagcgtaagcagatctaacaattactgggaatccaacaatgtcagcagcttccaaagcagcatcaacggtttcacaggcaatggactcagcagttggaatgtcgatctcttttagagcttgagcgaaaaggtctctatcctctgatgtttctagagtcttaattggggtacccaagaccttaatgttgtatttagctagtacgccagctttgtccaaagcgacaccacagttcaaccctgtttgaccaccgaatgttagcaaaattgcatctggtctttcgcgttcgatgatataggtaatatactccggagtgacaggcaaataataaatctcgtctgcaagagaatgagaggtctgattggtggcaatgttagggttcaccaaaattgtctttttgttagcttctttcaaagctttgatagcttgagaaccagaataatcgaactcaccggcctgaccgatcgaaagaccaccagaaccgataacaagcactgattccacaccttccactaactgtggattatattcatcagtgttgaatgccgatgtcgtgggttcggtagatgaatagatactagtagacatagcgagtaaaatggttgggcttccttgtagttgcttcttatactctactatcgtttttttcttttggcaacgactgatatcttttttgataagagctatgctgaagtttaaattccaattttgatatcagtgtattgctctttatatatatatattgcccaagctagttgttccttcttatttgcgatgagtcaataggaagatgtgataaaggttcatcgaaactaaatactcaaatagtgacgctgaaaaaaattgccaaatcgatgaaaaaacaatagaaaaaaactaaaaaaaaaaagtgctatgattcattgtaagaaacactgtgcagctttcttttctttttcccatcatatcatcattgatttggtgatgtaataattgtgcttgtgttgaaagctagagagagttctttcacttcttaaattaaaatttggaaagagctgtatatgctaattaaagctatatatcaagatcttccagaaatccaagaaataaaggacgagtcaataccgttacgtgaaactttctcgaatgcaaaaacaaacatcgggctattgacacataagaagagactcatccttgaatcataagacgcactacgttttggtataggtaccatttacgtttgtcttcagtaacaccgtagtaagaatgctgttttcaaactggggatagtttcgattgttcttgcacttagaggatgtaaaacctcgaactggattagaacctaagttttctgatcgtttagtgcaacactcagcgatgtgaaaggaaaagaaaaatcaaaggaaaaaaaaaaaccaaaaccaaaaaactggccagttacccggaatacccgggtaatacttactgtcttctaaaaatttgtcattccgtgtatttactgacgcgtgtcagaataaataaccagccacacaaagagtgtatgccctggcatgtgttaagatccatctatacgaaagtatacgagatagagaagtacaaatagaagagaaaaatcaatcttatgccaactcgtaggatgattaggcattatataatggaaagatgatggtggagggagcgagcgatactcaccatacaacagtgtataatgaatagtcaattgatgtcagatacagataatatgagcgaaggaatatcatcatgtcagggtaacactgaacagagagattccgggactcaatagcatggtcaggtgatgcaaataatactcttaatgcttgtattatattgccaactccgataaaagtttaactgacaagtattgttagtagggaagtgcggctgctcgaatcgttctacccaccaagacttcagtccgggctccagacgtggggtagaaatgtggattaaacagtatacggtctgcaaatggccgcccaacttgagctgcaaccgactagggaccgcctgaagatgaacatatacgataaaagacaaaaacaaccaacctcgatcacgtgataatcttagacatcactggcatgtaagaggtaaccctttcggctccgaattggttcttttgaagctgacaaccactgaaaattttccctggtaactcgagagacacattgaaaataataaaaaactgaaaaaaaaaaaaatcaccataagtatgccattgacccggagatttggcttcgattcagaacattttggtaatgttccgttcttattggtctcttcgctccgtctgatttttcagcttgccaactagttagtccggactccgatttgccggctacttaaccgctatccaacatttctcctactagccactcttcggtttatctctgctttcccccttctttgaattcatgcgaaacacaaaaaaaaaagacatcattcatttttccctttcgcccctttgcctgattgctaggttcctatctacctagtaccaccaaaaaaaaaaaaggcagactcaaaggccttatgattcttttagagaaagtatctctattgtaaaacatcccatgcagtttgcatgggaatattcatagagtaaaaacccattagtttgatccatatcgcctagaaagctcaacaggaggagtaagtagcagttaaagatcattggtggattccgagttgatcattgaacttaacggagcatttctcatttctcactgtatatacagttttacgtacttcccattcactgtccacttattttggttgttgagtagggtttttttttgttttttgggttcccttgcagtcaattctcagagttctacagtccgagcctctgcccgttaaatcagtactagatgtgggcctagtttttagtcactctctaatgggatttaatttcggtctttttacgggttttacttataacatagatttacaattctttaaacttttgaattttaggaataagatatataaatgtggggttttaattgagtttgatacttgggatttcaactaacttatatctgaattcgtttctgaattttttgcatatttatctcgtttccccttaaaggtgaatcacagataaagatagctttaaaaagtcgtcatatttgtttgtttgaggtattaaatactgccaaaagacaactagaagagaataataacgtgtatatttatattcgcacagtcggtttacagatcttttcgtctttttattttgaattatatcacatcattctacagaaatggcttcgaaacaaaaatcttcaaacccagctgtcaatttgattgctggcggtggtgcgggtctaatggaaggtctatgttgccatccattggataccatcaaggttagaatgcagatctacaaaaatgctgttggttccggtgtaaaagcaccaggtttcatcaagactggtggtgaaatctatagaaatgaaggtttcttggcattttacaaaggtttaggtgctgtcgtcatcggtatcacaccaaagatggctattagattctcatcttatgagttctatagaactttgcttgctgataaggaaactggtaaagtttctactggtaacactttcattgctggtgtcggtgcaggtatcaccgaggctgtcgtcgttgtcaatccgatggaagtcgtgaagattagattacaagcacaacatctaaaccctgtcgaaggtgctccaaaatacaagaacgccgtgcaagcttgttacaccatcgtaaaagaggaaggtttcagcgctttgtaccgtggtgtttcattgactgctgctagacaagccaccaaccaaggtgctaatttcaccgtttactctaaattaaaagaattcttgcaaggttatcataatcaagaaatgttgccaagttgggaaacctcattgattgggttaatctcaggtgccattggtcccttctcaaatgcaccgttagataccatcaagacgagattgcaaaaggataaatctactaagaatatgtccggtctcaaaagaattaccatcattggtaaacaattgatccaagaagaaggtttccgtgccctatataaaggtatcaccccaagagtgatgcgtgtggctccaggtcaagctgtcactttcactgcttatgaattcattcgtaaagaattggagaagaccggtgtattttgaatcgatctaatttatggttctcaccatcatttcttttccttcaatcatgctcctactaccatttctccctctctcattcaagacttctcaatcataattatagattttgattattgcattagaattttgatatattcataaaggtgttttccacaaactaagagaatggttaaagagacaaaacttcttgaagtatttcaagaagaactaaaaatattcccacgcatcattacgtttcttctgttaaaccaatgaacaattcacccaataaaattcagattaattatgagacgcagttgaaagataacacaaaatgttatgagatgctatagtgtttccaatattagaattcgccaaaagatcaacacacacacacacactctctctctctctctctctctctctctctctctctctctctatctccaccaaagtaactcaacattcattcaaatttttcacaatttgtatcaatattattattatcattattactacttttgtctctacccttcgttagaaactgaatgttttaactataacatagtaagacatttcttggtttcttatagcatctacttaggctaaagtatcgaataaactaaataatttctaaaaaaaaaactaatatcaacttcaatttaaatatacaaatgaaaatcccctttatcatagcgtcagattgaaatttgcagtttttatatgtgaacatgtcgcaaagtagtgataatctccagtataactcgttctgtgaaaatcttattcataacttcttgctcaatcaagttcatttcttccatgggatccaaatcgaacaacgttttagcatcgttctcatcctgtgaggttccatccacatgttgttgcaagtttaatattataggatccggttcagaaaaatcattgttaccttcggaattccgttctaacaatgattttaccaagtctgttttggatcggaaaaactctgaaattaaggaaatgtcagattgtatactttgagtatcttcaacactctgcagtaaattcgagctcacttcatcggtttgattatctaaccatctggtcatatcatcacccttggtgacatcatttgtaacttgaaaatccgtatggtacaccatccccattagctgaggaaaacctagagtgctaggttcttctttgtcgtggaattctatctctgaggaatgttgtgtcattattgttgcactgctgtttcactgctgtttcaccgtatttcttacctgttgtttcttaatcagtcagtaccaaccttttcgaagtaaattatggtcaaaagaaataattagttcattgttaactatatggctctttcgtttgaaccaatggtatttaaatgaaaagttctattactctgataaagttcgggaactgtcattacgtttcttaaacaagactactaaatcgacatttgtaaaaatacttgaaactgtaaagcccttactgcggaaactcttgttacaacttagaattatttgaaaccactacctgatcgtcagtacctacattttgtatagtagtttacagggtttcggtactatttcaaaattttccatcaaaaattaagaaatcttgacccttttttattctcttgacacaattttttttaagtaggtttatatcaaattacgaaggaaaagagcgttagagggcattgtgccttaggttcttgaaatgcagctatcaccatgaatatatattacgcatatttgtttgtaggacgactagttctattatagcgccattaatagtgtgttttcgggactaattgcaaaattaattagttgcctgtgccttttctaaagttccaccaacatagtgtattcgtggcatttactgtgccagtgaccatttcaaaaactgtcctgctgattttcctactgacagggcattcgttactggaaaccaaggatggcaatagctgaaatgctttgaaaaaaaattgaaacacagaagataagcaaaagcaaattttaaccaattagccgggattataagaacacaggtgagcttaagtccgttttgtattggataggaagagttacgtctctcaagttttttaccccatgttttccattgataagtatttgtaccaatataagactgggacgtatagtactctatgaaagtgtaattctctttaatagaatccagaaccaaacctcactgactatggcggaccgtaaccatcacgagttgccatgaacgctgtcctataagcaggttcattgcatcgtacgaaaactgaacggaacatctaccgaaacagcagaaaagggaaaaaaaaaaaaaaaaaaaaaaaaaatacgaagtccgccaaattgcataaaatatacatagaaagccaagagcaactgcaatgatgtgctttttaacaagatcttttaccggaattattaaattcagaagctgaaaggacagaatccagtgtttaatgataggagagcacagaaagatgtgcagagagatgtttttagttgctgtatatattccctttattcttttttctcatcactatacgcaaagctcgctcagccaatggtccacttgtatgcacgtacgtacacattgttacttatgttattagttgttttttgcaacggtagaatatacacacgagatatataaatataggttacggagactgccatgctattggtttttaagggtacataagagagtaaagattaaaaaaaaagctctgtgttaattcgctgctttaaaactgaacaagctaagtcagttacgttgaattaagactgtgtttcgtcagcgttttctaatcgatcatagagattaatttactggtaaagagtctttgcttttagttagtgtttctatttgttctatttttgtcaaaataagtggttgaacatggaactttcagtgccaaaatcttacaagttatctagtggctacactatcccatctgtgggtcttggaacctacgagctaccaccaaataagacagcttatcttgttcatcaagcattggaagttgggtacagacactttgacacagctgttttgtatggaaatgagtacgaagttggtcaaggtataaagaaatggctcaatgaaaaccctgctgaaaacaaacgaggagatgtattttatacaaccaagctatgggattctcaacatgggtatgaaaaggcgaaaaaggcaattgaccattgtttgcaagaggtggaagatctcggttacattgatttgctcttaattcattcaccgttaggtgggaaaaaattgagattagagacttatgaagctatgcaggaggcagtcgatgcaggcaaggttagatcgattggtgtttccaattatgggttccaacatattgaggagcttttgaattgggaaaaattgaaatataaacctgtcgtcaatcagatcgaaatttcgccatggtgtatgcgtcaggaacttgctgatttctgcaaaaaaaagggaatccttgtggaagcatacgcgcctctaacccatggcacaaagctcaaagaccccgatcttgtcaaagttgctaatgaagtaggctgtgacgttggtcaagcgctaatcagatggtccctacagaaaggctatataccattaccgaagactcaatcagtttcaagacttgccagtaacctcgacgtcttttcattcgaatggaccacggaccaaatggatcaattagataaaccgtatgcatatgaaccaactgattgggaatgcaccaatgcaccatgaacaagtcatataactccagggttttcttggtgccagatgccagccggtatttttttttttcttttggtgaaatcgttctcgtttacaacatcctacctcttcttttcaattcaattcaattctttatctgacctttatatcacaaatagctcataactttcatcaaattcttctctttaccttatttcactcaagatgcactctagctagtgatatatggtcgtattaatgcaggaaaagcgttggaaaccctatgaggctgcaaggcaagacctgaaaagagatagtcacgtggtagttagggtaatgaagtcgttctttttctttagcttttttctttaacttttatttctttttcaatctgccgtatataaggaagaaggtcgattctcattccgttcttcatagcataaacaatttcaattccaaatctaaagatttgagtcttaatagaccaacatattttttaaaacactcttccggattaccagctgtggcattgttcctccatatgttcacaacagcaaaaatggctggaagtagaaaaactggcggttcaacgctaggtttcagggtatataatctacctcgataggtttttttacaggcgagatactatatctggctatactatcttggtggttcgcttcctggagacatctcccccccccatctttctcttgtattgtaatgatatgttttttactttcaacagtgacatatagtagattcactttattgcctattagatctatcatcgatcatatttttgtcaatgtgacgactgtgtatagcaataggagggtgatcgactaattgtcatctccatttcaaaaacgtccgcggtggcactcatgaccttaccttgctatgaaagtgcgtttttgaaacatgtaatggaatctatcaatgcttggcatcaatcaaccttcgggtgatttcgacagtgatgagatgacactatcccaacctatgtaccgttccaaacaaaacttcaacaggtccggttttgaacgcggtgcattccttctttcttgatgtcagcccctaccggcggtatactgatcattaagattgatacgaaacaccgactgttatctccgttgtccttcattttttagatcagtactaccatcgaactaaattattcggcttttttactctcttttcgtcattatgaactctaaatatgatagtataatcaactggttgcttttttcgttggagccgcatagaaagcaacccgtcccacacccagctacacttaaacacagaacaagagcttagatatgacaaatcttctgtcacatcaacttgtctttaatatatatatatatatatgtgtgtgtgtgtgtatatgactatgttaatacatcgatacagtctaccctgttgatctattgtcctatgtgtaagaaacattattgactctgcccttaccaacattgcatttgacaagaattgtcttggcattattaagtatatgatatcaatgcattaaaggcacaaagaactcacttccagaaaaagtcatagatatgattgagggtgaatatagcgatgaaagtaaactgaaaactatggacgatgaagaatctcacgtttcagtgagttcatataacaatatggatgacgatgatgacgaggtattggaagaacatgctaccgaacctcagaacttgtatatggaacatgctgagaaaatacaaaaaactgataacagactagacgtgacggattcaaaccgccagctttccttactgaactctaccaaatctgagacaaactttgacggcattccttacacaagattctctaagcatgacaaacttttcctagtggtaatatgtgcgttgagtggattttattcgaccatcgctcaaacgatttacttcccagcattgagtattattgaaaaagaatttaacgtcagcgtgagtttggttaatgtaaccgttgtagtgtattcactatgccaaggtatcttccccgtgattatgggaggtttggcggatagattgggacgtcggcctgtggctatgttttgtattatggtttatttttgtgcttgtataggaatcgcatgctgtcgaacatttggagagatgattttcttaagatgtttgcaaggtggtggtatatcgcctataattgcaattaataacggtttaatgggagatatcaccgtaaaatcggaacgaggtggttatgtcggattgacaagtggtttccaagtgttgggaagtgcattaggtggtctacttggtgctttattcactgcaagatggggctggagatcgatcttttggtttttgtctgctggttccggtgtaactttgctgtttgtggttactgctttacctgaaactaagagatctattgtaggaaacggctcaatcaaaccacctcatcttattagcaggtctgtcctcttgggtgcaccatattataaaaaaaaattgcatttagacaatccagattatgaaacgaagactgagaatgcctcatatgatccattagctcctttcaaaatcatggtaagaccggaacttatatcgttgttggccgttcagggtttacaatttacaacctggatatgtcacatgacgaccctttctgaacatctaaacaaggattatggcctaccgatggtaattatcggtgtttgtttttacctgccggtttgtgtacgctaacgagtgttgttttagctggtaaattcttaaactggaattatagaagaaggttcgcgaaacataagaagttcatccaaaacgaaaagaaaatactcttagaagagaatgattacgattcacaattggttagagatatcatagaccaagatattcagcataagtttgatttatacaagaccagattagattatgcttatgtgcctatcataatttcaaatgcaggatttatcatttttggctggtgtattggaaccaaacagcatttagcagtcattttagtgatgtcaggtctcgcatcattgatgtgtaactgtatgatctcaataagcaatacgttggttgtggatttgtatcccgaaagagcctccactgcagccggttgtgtcaacttcgttcgctgtatcttcacagctattatggttgcagcgttagctaaaatgaattcatcaatgaccgttggtggtacgttcacctttttaacttgtttggcatgggtctgttctatgttactaatagtcccaatgaaatatggcttaaggctgcaattggcaagagaaaagaaacaaagtcagaagacactcggaagagagaatatagacgaaaataacatacatcctgaaatgtctgaagaagagagagagttgtgtgatcttcgtcgctctgctacagccctttctaatttatctgcagtgtaatagcgcattcatctgttaagaaaggaaattgcaatacatgcaaatacatatatataaacaacaagtatttgttcataggagtgctcgtgcattcaatttaattctaattttattctctaattcatgtaagttaaactgttgcgttatttgacctggctgtggtacgcatttcatgactaaaccatccctttcactatctgtattgttgcaggatgatctgtgcagccgatctgttttttctgcatcaggttgtgcttctctcaaaaaagaaatcatgtgtcataagagatatgaaataggaaaacagaattccaccatgacgcacatcagaaatactaaacattattatagatggtataaaagtcaaaagacaaagcagatctgaatcggtgcacatctgtacatgtgtactgctatttcaattcgttgttcttattgatttgttatccccatatttaatttagaatagaatttgagatgcaaagaaactagtaatctatgggattaaacagtaaagaatatccattctatttcattcaaccaaatcgctaaatcaagatatcaatattttggaatttgacggaccattggaaaaggattaaagagtattaattataaatcatttttcgattcgaaacgattctacaattgcaacattcatgagaagagctagtatcagaggaacggaccttcaggcagatactgaaacgaaaaagaagaactgcgataacacaggatctgaaagctctgtcttcaggactgtaacaagagaactgcgagatgacactgatgatgttgtgacgcatgaaatatatgatgaggaatctttccctgatggttcaaaacaggaacaactctcagaagaggatgtgccgtatacccttttaacgtaccgtcagaaatggtttatggtcgcattattgacttctgcaggcttctggtcctccttagggtcgccgatttactatccagcgttgaaagagttggaagcagagtttgatgttaatgaagaacttattaatatcactgttgtcgtatacttactttttcaaggtatagccccaaccatcagcggtggtttagcggatgtgtacggaagaagacctattattttgttaggaatgttaatatatgtgattgcatctataggtcttgcatgttctaagtcgtatggtgcggttgtgttcttacgttgcctgcaaagtgcaggtatatctcctatcattgccataaattctggtgttgcaggagatttcacagtaaaatctgaacgtgggacttttgtcggcgctgtttctgggtttactttaatgggccaggcgttcggctctttgattggtgcagccttgacagcggcatatgactggcgagcaattttttggttccttgtaattggatgtgggacttgtatgattattctgtgtttcttgctaattgaaaccaaacgtaccattgtggggaacttatctattagaccaaaaagttggataaatatagccccaataactcgtttgcctgcaataaggaagcaattcaaatatgataatccagattattcatcaagagacttatcagaagtgaagttcgatatcacctcagcaatgagaattcttatattgccagaaatcatcttatcacttctccccgctgcattccaattttccttatggactctttctcttgcttctcttccagcggaacttgcattagatccatacgactactcattgactatgattggtgtatgctatttaccctctggtatcggtggcttgttaggatctttctgtacaggaaaaattattgatgtgtattataaaaggtcccataaaaagttcttggagaagaaagaggcaggtcttatcgataaagatgcaagatttaatacctttaaggctagattaatttctggtgctcctcaaaatgtttgcgctgctgtggttttcactctattcggatgggcactgaagcaaaggtggcacattgcagttgttttagttacatccttcatcggctcgttttgtgctatgagtactctttctacttcaagtacgcttttggtcgatttatacccaagtaaatcctcaacagcaacaagctgttacaatttcatgcgttgcgtattgtctgcaattttcatggcatgtttctcaaaaatgaaatcatcgatgaacgttggtgggacattcacctgcatcagtggaatggttttcgttgggaactttttaattcttattcccatgaaatatggtatgaagtggagatatgaaagaggaatgaagctttgaatagtatacagatgttttataaacatttggagcaaaaagatttgattaccacattcgatgcttcccatttcgatgcacaactaattatagatcattaataaatatagcagtaattaacagactttgatagaatgtcacgtaagacccatcatattaataattctatttcgcatcatttactttgatgtagcatgtcagaaacttctgctcagagtcttttttgccatgaaaggtatggggtttttccgcacaaataagaacgctctataagaataacttcatgcataaattagcaaaggtaacaaactacgtcaacagtgcattagcagcaaagaaaaaggaaataaaaaatacgaatgaatggaaaccatgatatattatgataaaaaaagtgaaacgattttaccagaacttggatgttggattttataaatataacctttatagttgatgatagaatgggcaattcgcccaaaattggcacgacaaccactgcatcaccgataaaaaaagagaagaaaacggtaatatatcatagtagaggagtgaatgcggtagtgtatcaatttcaaaatgactagaaatgacaatgtgatgatagtatatttattggatggaatgtgagcagtgttgaagagaatacaggaatcaattcattttaaaaacagctccaccgaaaaaaaagatggtgaggtcaaataatcaaaggttgtatctcattgattactgtgaggcacattgaacaccttcagcaccgtggtgtccgtcttcatcatctgaatcatagctttggcctctgccgttaccaccagctctagcaccatgcttactggagtcgaagtctgctaaaacacaatcttcaacttctgcgtccgcaggaatagaaggtacatttcttggtggtagaatttcctcgagcttcttcaaggtttcatcgtccgtgaagtgtgcaggtgggaacttgatgttgaacttgatcaacaagttaccgtaaccaccgtattttggaattggcatacctttgccttctataactttaacagaacctggagagatcacttcacctggtacgatttcgaccttcaaatattcacctgatacgtgtttgacggcaaattgaccacctgcaatagcagatagcaaatcgatttcagcgtcgtagtgtaagtcgttaccatctcttttgaagactggatgtggttgttcagaaacgacaaagacaacgtcacctggaataatacctggagattggtcagcttcaccctggaaaacgattctttggccgtctttcatacctggttcaatgttgacttctaaaacctttctttcgtttacaaccttcttaccgctacagaccttacaacggccctttggatcgattatttcaccagcaccatgacaagattcacactcaacttggaatctttggatcataggacccatttgtctggttacgaacttgaaaccttgaccgctacaagcagtacatttcttaacactaccttccttaccaccacgaccttcacatgacttacagattaactgtttgtttaatgccagtttggcagttctacctttgaataattgttctaaagtggctggaatttcatgtctaatatccctacccttttgaggacctcttggtcttgaactaccgccaccaaagaattgagagaataagtcttcaccgaagccaccgaagccacctggaccgcctgcaccttggccagaaagaccttccaaaccaaactggtcatatacttctctcttttgagaatcagataagatttcgtaagcggaagtgatttctttgaatttctcagcagcttcttcacttggattcttatctggatggaattttaaggcgctttttctataagccttcttgatttggttgtcatcagcacctggagaaacccccaaaagatcgtatagttttgtatccttaaccatcgcttattatattttgtttcgaatgccctttaataattaatatatccgccaagatcaaaatacagtcttttcactaatttctgactgactgaatcgtaataataaaatgtctgaatgtaaacgttcaaaaaacaatgtagaaccaatatatgtatatcgatgaactctaaaaaaatcaaagaattaagaccttttccttttctaaattgcaaacgctaacgactgagatgttaataacgatttgtttgtaatcactattcttgtcgcagattgtgtttcagtaataaaaaaacgtaataataacgtcaaatgctcctaaacacgtagtcaaaaagatggtaagttaacagcagcaacctttgtaattacttgtccttgatgatccgaaaacagttaagttactaagctctaaaatctaaaacactctccgtttttgccacgagatgaggttcaccagtaagtttttctttaatctatgtaaaatttatattccttcgcatcctggaatttgtcgaaaaattgacgaaatttcgagaaaaagtaagaaaatatgtcgcttgagacgagttgaagttacacgtgatgacaaatgttggctcaattggctagttcgaatggctcattcaatacatatcagaacaagagcgtctttagcattgctgttattgtctgcttcgagttgcgctgagaagaataggaggtacttacataggctttcagcttaaatagtattcctggctctgatgaggcaggctaaccggttgttcgccacctgtgaggattcagggtttcttatttctgttacccgaacattatgcggtatgagtcgcactatatgtaacatccacctcatctcaactcatctcgaatcgtaattaccgagccgttacataaacaatcttatttcagctaagcagtgaaggcatgccacgaatatcaccccgaatactcaaatcagtagctaatattgataggcgcctgccgtatctgttattcgagtgtagtggtaatatttccgatgccaaacaagaattaagctggatcaagaatgaacttcaagatgcaaacctaataaatagagcatgctggcttagatataatcgcgtaccgctacagtatattttgaaaacccaacctttcggaccattggaccttttggtgagaccgggggtacttattcctagatgggaaactgaggaatggtgcatggatttaattgccaagttaccggaaaaggcacgccaaggtcaatttaaagttttagatctttgttcaggatctggttgcattgcattagctatagcacatacaagaacggaatatatcgtgaaatcagtggacctttctccgaaagcgattgcgttactcaaggacaacgtaagaaaagttggtttgcaaaataccaatgttcagtgcattcaggcagacattctgagacattctgagcatatttattcgaaagataaattcaatcttatcacttgcaatcctccttatattccttccaacaattttgtaaaagaatgcactacttcggtgaaattgtatgaaccaaggttagcactggttgccgatcttgaattttacgataacttactgcaatactggattccacgaactgagtccttcgtttatgaagttggtgacatgaaacagtgtcaacatgtgataaacggattatcacataataccagctggaagacagggattaaatatgattcgaatgataaacctagatgtgtttatggatatttagccaatccagaatctactatcgactatgtaaagatatttgattcgttctcaacctgatagtttagtttttacctatgtatgttagctttacctggtagatcataatacagaagaaactcgcaaggggattgaataaatattctataaagtattatacaaatgatgaagagccattatgggcttgcaagattctgggtttattacatttttcatagtttctcattgtcctcattcggctttcttctcttgattacttgcttttcctgatcaagcttatgagcatcttcatctccttcttcgtcagaatttttaatttctgatttttctaacgtctcttggtggagttttggttcagcagccggaagtactctatggcaccacatgaggtaaccaccgcctcccttcattgtcataagaggatgtaatttacctcttactgtttggtacggcctgcatcttgtctccaaaaggcttggtgctaagtagttcaagttttcatacagagagtgactcaattccagtagaggttctttatactgtgaataacacacgatcggacgagatccgtgtattttttctcccaatctcggaataagtgtcggaaggtacaaagtagatgctactaaaaggccatcaaatgaacttgctgcaacctcgatatttgatagttggttgtgataccatttaagacgacgaaagtaagcacttttcttattacttttcaggtcattgatttcttctgcagatagaggcttgaagagggacttaatatcagcttcctttgctggttcaaagaaatcaagcactgaaattgttttgacgtgacgttgaatgaagttgtcagaataacttgaaaacttcaatagatccaagtttggatgttcattctcatgaacgacaacaatcttaccgtttgccttggagttgctatctccagcaaacattctttcaagcattgcgtacactatgagacctccagtctcatctatgcataaatattgtccatttgagttgatattcgctaaattcaaagccatgcctaaagattcctgagagatgtccataactctcagaacatcccctttttcgatgaggtaatgcaataatccagagctatcaaggtattcaacagtgaagaatttggcaaatttctgcttcttccttttcaaatacttctcctgtgaatgaaccgtcttttgatggaaactcttatgcgattcaatcattttggagatgatagcgtcacctgaagcagcttctcgtttcattgcttcaatttctgccatagacatttcttgaaccacacttccaagatttatcaatccacggttattttcactgctattctccaatgccggcgaagatgcctttaacctattttccaacacagagatcttcccaatcatggtctgtgttcccttgacaaactcttcctccaccccatcatatacaatatcaaaagtggtaccaaatctgtagcctataatttcatttactctgaaagcaccaaatttacctaatgatacaatagcattggctttcaattcaacaatcttcaaattatcactaggcaatcgaattaatacatgttgattgggactaatttgtgttaacggatcaatcccggagtgtttcgtcattagattttttttgtgtttaaatcaaaccgtacctggtactgaaatcagcgggaaaccacactttattacagctttctcaaggatatacaacgtatacttttccactcatctcatctcatcttgatgctcatctcaatttttcattgaaactttacatcttgtaattacacacgagcaacatttctttttcactatttattcccataataaaattttctgtttcgaactgaaaagtgaaaaagctcatctcatcacatcgcatcgcatctcatctcatctaattggtgttatagtaaactagtatatcaacatttgtccagggtgttctcgtaagctgctgtgttgggtctgtgtgtatcaaaaccatatcttaaataattgaagagaaaagatgggtagcagacgtttaaagcataagcaaggtgctccaccaactttggaggaatttcaggccaagaaggaaagacatcagcacaggaaagaaaaaaccaagagagttagtgaagaagatagatctgatgagacaaggagaagtaagaaatccaagaaatccaagaagaaccaagaggatgatgacgaagcagcagctttgaaagagttgaaaaaagcggaacaagagttaccagaagttgattcgaaggaactagcagctgccaagaagactttgttcgatgatgtagaagaagatgacgaggagttgaaggatgaatttgacttggaacaagaatacgaaaatgatgaagatgatgaagtcgaggaacgtccattgttttctgatgatgaagaagctgatatggatgagttgaacgcagccaatatggaagctttgtctatgaaattagatgaagaggccaaattggaagaagaggaagccgaggctgaattggttgaaactgataagatgcaaccaagagctgaaatcttaccgaatgcagaacaagaagctattgaagaacaagggcctccagatttaacagctatcaggacaagaatgattgaaatcgttaaggttttggaagatttcaagactttaggtgccgaaggtaagtcgagaacagaatatgttgatagattgttgaaggacatctgtcattactttggttatactcccttccttgcagagaagttgttcaatttgttctctcctgctgaggctatggaattcttcgaagctaacgaaatcgccagacctgtaactatcagaacaaacactttgaaaacaagaagaagagatctagcacagaccttggtgaaccgtggtgttaatttacaacccatcggtagttggacaaaggttggtctacaaatatttgactctcaagttccaattggtgctaccccagaatatttggcaggtcattatattcttcaggcagcttcctctttcttacccgtaattgcattagatcctcaagaaaacgaacgtattttggatatggcagctgcccctggtggtaagactacttacatttcggctatgatgaagaacactggttgtgttttcgctaacgatgccaacaaagctagaacaaagtcattgattgccaacattcatcgtcttggatgcaccaacactattgtttgtaactacgatgctcgtgaattccctaaggtgattggtggttttgatagaatcttattagatgcgccatgttccggtaccggtgttattggtaaagatcagagtgtcaaggtgtctcgtacggaaaaagattttatgcaaattccacatctacaaaagcaacttctattatccgctattgattctgtggattctaactctaaaactggtggtgtcatcgtatattctacttgttctgtcgctgtagatgaaaacgaggctgttgtagattatgctttaaggaaaagaccaaatgtaaagttagtggagactaaattagctattggtaaagaaggtttcaccagttatagaggtaaaactttccatccaagtgtaaagatgactagaagatactatccacatacctataatgttgatggtttctttgttgctaaatttcaaaagactggcccatccaagttcgatgataatcaagctagtgcaaaggagaaagaagctgctgcaagacaagaagctgttgaagaaggtattattaaggatgactttgcttcctttgatgatgaagatgatgaaaggtacatcgaaagatcaaagaaggttggccttctaaagaaaggtataaatccacacgcgaagaagccagcttcttctgataaaaacaagaaatagattcaacctctcaaatcatagataatctctggcatttataattaaataaggatatgcatgcaatccttaactgtacatttagtttagattaagaatttatatatatttaatcttacattctttccaactttaattagtcgacaaatcgaacattacccaacttgtgttctttgatataattggggccaaactcttcatactccactttggtaacgcaagtacttgaataagtatcgctacgtgcaaactttgccatacccttccacgcatcaagcgagacgttttgagcatagtttacattcaatggagtgtttacaggtaaaaatccagtgaactcattcacaattctttcgcgaagattgggaattttagtattaccaccggtaatgaaaatgtttgatgccatatcaaggcattgttgagataatttactcgaccctgatccgaactttttagttaatattccatcggctaactcagcaatcccagcttgatctagaccacccattgagggctgaaaaatgacttcaggagctcgtattctttcaatatttagatgtaattgatgttgttgatgaacatcttctccattatgaggacgaggacctcttaagaaaagatggaggacggaatttctccaatcatactgcgcatctagggtgtcttcttccgtgaatgatggatcaaactctaacaaagatttctctagttccacaatctcccggtattcatcttcgatggattcgtctaaagcctctggtgtgattgctatatcattatagatagtccagtcatcgtcattcgcaccgaaagtgtcagagggatcgttatctatagtggcctgtctagatcttttaccgggaccaacactgtcctctgccaaagatgcaagattcttcattcttctttgagtagcttgtgatttacggtccttcatttcctccttcaacttcaacttgtcctttctacttttgatcaatttcgcgagtttgaatcttttgtcccttgtccaccctttcaaatcttgtttccgccaatcttcatcctttttcttcgcttcttccaatgccttttgcaattgtgctttttcctcttttgcctttaatcttgcttcaatgttagcctttaatagcctttgcttacgtttctcctttttttgttcatcgtttagctcttcatctgggacatccactaaatcaaatttggactcctgagattcttcttgatcgtcgtcttccacgtctaatatacggcctcttttcaaaaccttttcaaggtttgagatgtagttgataaagtcttgttcatcgtcaaatcctgcgttctgtagagttattaaaatttgtctcttcggttggtcgcgcaattcttctctgatattaacataatactcatactcttcctctttttgacgaagtttttctaaccttctttgtttggcttgttcttgtaacctcttaccagtctcccttcttttttcagcttggattctaagttcttcttcggtcttttgtggttgtataacttctgtgaaaggtgcttctagtacaatgtctttgttttccaaaacgtcaagcttgaacatgtcactaacttcttcctcgtagttttttgcaaaataacaatgattctggtacattgactggaaatgataatcggttaatttagaaggaaaatacggatacttcaaagataagaggctctttagataatcaattgattggttaccaccccagtcaatcctctttgcttcggagagtatccctttacctttaatgacaggaatgatgttggtatcctcgtggccactatttattattaacccagttgaatcaggtgaattatttgcatagaatgaaaaaagtccatctattccgaaagttacttgcggtattccgtagcattcaaacagtagctggtaccaattcgatctttgagcttgcactgtagccatcttttcggtaagtatcatgggattcgaaattccatcattaggttgaacgccaaggtgatggaaagtataagatagcatatcttccatatactcccaattggtgatcaaagacccatcatatggagacctactatgagatcttactgcattgtcgagactacagtcatttccaatgaacgtcaatgccttttggatcttcctttccttataccttactatcttcgttgggaaaacatgcgatggggtatcttgtgaagtgaatccagcccgaacttcatacgagccgaaatctaatgcaattggggtgtttggattataatcattaggatcatcaaaaggttcaggctccgtagttaatggcgggtcattaagcgggtatactgtcagtggttgaagactagaatctcgagtgttcgccgtcattgttcttgattacagttcaaagaaatagaagagaagaaaaaagattagatcgaccaaattaccgtttttcttttcggactgagaggcaaactttggttagcagacactttaaaccacggttactgctcgacggctcgtttcttgataagatactcgacgatatatgaggccaaaacttgcacgtattctcccattaagatcattgacgagaccttaatatttcgaaatcaaagaaatcgatgttgaatgaaggttattacccggactaaacagctatctaatatacactacgaaataaaaattgggtcccattaacaccattcgaaatctctgctctaatccaggtagtgtcagcaatagttgattcaccatagatcttgtttggccttccgttaatccaatgtatcccaattctttcacatcaataagtatttattctccatttcaacacccgtacagcacatattacattcctcttctcggtgttaaagtttcataatcagatgagaaaacaggaattcatttcaatttgaaatccaaaacctgaacgcttcccgcaacacatagagaatacacatagttgccgcgaatagtaagcaggataccggcagtacagttagtgagcgagtcaactttctagtagataaccgaggttcaattcaggtgcttgagggattgtggtgctgatcggttcaaagagcggaagttccaagaaattttcttttttctggttttatatcgttgttaatttttggataaggatttccaaaaacaagatgcctctctgtggtggttcttcaagcaagcagccaattgagcgtaaaatagtcatattaggagatggtgcttgtggtaagacttctcttttaaatgttttcaccaggggatatttccctaaggtgtacgaacctaccatctttgagaattacattcacgatatatttgtggataatcagcacatatctttaagcttgtgggatacggcaggacaggaagaattcgacaggttgcgatcgttatcatacagtgacacacatactattatgttgtgtttttcggtagattcaagggactcgctagagaacgttcaaaataaatgggttggcgaaatcgcagatcattgtgaaggtgtgaaattagtacttgtagcgttaaaatgtgatttaagaaatttggaagagttcgggaacgaatctgctgccattaccccaggctctattcagaacaggaatagtaacgctaaggataatggattgattagttacgaagaaggtttggatatggcgaagaaaatcggtgcattgcgctacttggaatgcagcgccaaaatgaatagaggtgtcaacgaggcattcaccgaagctgctcgttgtgcattgactgcaactccaaagggggcgaatgataccatccctcaggataaaggaagcagttgtattattatgtgatcttataaaataacaaactacacttacttacgttaagacggaatagaataccaggataataatgcagtaacggtttacttcgggagaaaaatgaggggaaagactaacatgaatatagctaatgttttcgcttcttcttcatttcaaaattggcgatgtaactattgatattgatattccacctttaagccgattttaattcttgtcaattgcttcaaaccttaaaagagggctagtcagtgtattgtccatctgttcttctagattcacaccactaattgcagttcatcgcattgacatgtgagacgattcatcatcttcaaattttgatgatcatgatacatatgtatatatatatgtagtcttttcctccacgaggaaatctgttgatatcttattataagcttttgttataaatgcttgcttctatcagttgatgtgatatttctaggtattgaaacttaaagaggtacattgtctatatctattttaatttaatgttttacgtactgaactaaaaacaacattcgaaaggtagtcattgtttcatggccctcaatttgtaaaataatattggtctacgaattgtcttctaacatgttatccaaatacactgaaggagtaatagaagatgatttattgtgccctttacttctgccctgtcttttttggttatcgagagtagtggaagctgttaaatcaattgttgaatccaccaatttgctcaaactggatttactcttttcatgcttatatgttcttctttccggagatactgtgcgtgttggttccatcatctctggtgtatcgatagagactgctgattggttcaagttattgaacagtgtcgatctccgttgttggttcataacttccatcgttggtgagatgtataaagatttcctcacacctgtattggctgcatcaatagcatctactctttccagtggattcatagatcccagattggtattaccgatagatgatggtgttcctcctccgaaaccatcgtcggtggatccacctaacagtcgaatcatgctatgagatgccctcttatacggagtaaacgaattgtttccgccatttttcgtaggcactggagtgtctttgtatgtgctaatatcctcatcagctttatagtagccaccacctgaactgaaatctatatcgtctatgaaaggattttggaactgcttttccatattgttaaatttctttagctgtttcgcttgagagtaggacatccatgtgttgataatgaaccatactaacaaagctaaaaatatgaaccctgcagcactaccgacagcaataaatacagttcccgttggtttatttgatgaccatatgttagggtttcccttagctgatggaagttccatcaccggggttgtataagatgctgtttcagtagaactagttccggtacttgtggtcaatgtacttccatcggtggtcttagtcgtcagactgggcagcttggtatttttacttgaagtcccggtactagttgaagtgctggtactagttgttttatcatcgtctgtattggtagaagtctgcttagctgtcgtttcttcggtacttgtggtcagagctggtagtgctctttcttccaaaacgaccgcgctagcctcgtaatattccaagtccatcttcactaatttagtatccactgcttggtaccgttgctactgccaagaattcgacgcgttaacccctgagatcaggattgatttcagtttgtcagtttgttctttgtttccaattacatttccacttttgtgaagaatctcttacttttctgataatgaagtaaatctataaataatatcaaacaccaagtaagaaaggaaaaccgattcaattagagacagtctaacagaatgtcattactgtgtagtagaggataacatccgatatctctgtattcctgtatccaatcatttttcaactgaaagggtttccaactgtttgttcacctatttgtccctatgaagtacattcctccactaagttttgcaccggtcgtgggtacggatgttgacctatacaggtcggggtatccgatgcccttgaactattcgttcataaagcatcaattgcatttaaaaacagtgatatacgtcggtgacaaagatattttgcccgaatacaaagcgtttttggaagaagaatccatcaaattccaccatataccgatgaagtctacgaaagacccagaaatacaaaaggaaatggaaactgtacttaaactggtgttagacgtaaataactatccgattcttgtgcattcaaacaagggcaaacatcgtgttggtgttgtagtcgggataattaggaaattattactcgggtggtccatgacaggcatatatcaagaatatgacttattcactggagggcaaaagggtgatattgacctagaatatatcacaatgttcaacacttcgattaacgtacccctggacagattgcctgatttcgtcaatttcaagaatcatcctaacgaaacccatgaaaagctggccgtatgatacggaaattgcatgctcagctattcctatataacacttgtttgtttgattttcaatagtatacttctacaaatatagattctgactgttttggtacttcaatccatcgcagctctcatgctgcatagtcaaatattgttgtttatttcttcatgagtcatctcatcccatcttctcaaagtcagatttacagctcatccagactctacagggaaaatgaacattcataaaaagtgaaaaaatacgagaacgttttagacgtacaactcacagattaaagttgtcaattgatgggagaaatgtacctcctgcagccactacatactcaggtacagcgctaagagtgttcaggttttgttacacgagatgacttttgatatagctaaagttgtgaggccaaagattctgaacttggagccatatcgctgcgctcgtgatgatttccaagaaggtatcttgttagatgccaatgagaacccatacggacctaccattcaggaatacaatgttgactctctgttgcatcgttacccagatccgcatcaattggagtttaagaaactcctttctgattaccgtaacaaaacctctattttcaaagaccagaacttgaagcctttggatgctgacaacctatgtcttggagttggatctgatgaaagcatcgatgcccttattagagcgtgctgtgtgccagcaaaggaaaaaatcttaattgcacctgctacgtatggaatgtataccatctgttctcaggttaacgatgttgaatacgttacggtaccattattgttatctgaagaagacaaattccaaatcgatgaggaaaagatcttagaaactttgcaaaacgatccctcaatcaagttggtgttcattacttcaccaggtaatccaactggtacctttatcgatgttaatcgtattgaaaagattctatcacaatggcaaacgggtcttgttgttgtagatgaagcatacatcgattttgttgagggttctgataaggggtccttggcaccgctagcaacaaagtacgaaaatattgctgttttacaaactctttctaagtcatttggcctagctggaatcagactaggagttacgtatacatctaaagctatgtcaagagtcttgaattcgatgaaggctccttataatatttcttgctcgactgcagaagttgctttgaaagcagtacaaccaaaaaacttgaaattgatggaagagaatgctgccacagttaaaaaggaaaaattgagagtgttgaaggagttgacttcttctccatatgtttcccaattgggtggcctagacgctaatttcatcttattaaacatcaacaatggagacaacgctttgactaagaagctatatgaaaggcttgccgttgaatcagctgttataacaagatatagaggtaatgagcctggctgcgcaggtggtttaagaatcaccattggtactaagcaagaaaatgatgttctaattaaagagttcaggaaacatcttgctttaataatggcttaattaaggtttgaaaaggtggatgcaagcaattatttagcgtattcaactggaccatttcgttctacacattacgtagacagtttagatgagaaaaaatctcctaattgagcccttgtatataactccaaagtagtttcgagaaggggcaacgatgtagaagctgtgttaattaatagattctcaggttctagttggtttggtttttctgccgacaattttaacacagaaatttcttctcttaacgactgaatctctgttaacaagttttctctgccaatgcctccgtttaatgacaattgctgcacagcatgcagtgcttccttggtatttgtaagattgtaaagctttagtacttgaatggattctctaatttcatccagtttcgaggagacttcttcaagtttcctctttaccatagttgagatatgatgctgactccaagaaagtttcctgttggaatgattagatgtcctgttggagagttcaagaatgtcatattggcgttttagtgtcgtgattagcatgtcgaaattagttaccgcagaagaactatctgctaacctttggtaagactgtttcaattcgtagctttgtttagccttggaagtaaggatatccaaaagagtggccgcctcaccaagtctccaggaggagacaattgggacagttttctcagtacgtttgaataaattttgggaatggtcacctataaacttcccaatgttgtcgatatttgagcgtaacacttgaatgtttgctaaaacttgagcatttgttttttcaacggcctgtacaacttcatcggaagatattgtactgaattctttaagttcagcagtggaatagaaagcactaggcatttcaggaagatacctttcagctatatattgctcatcattttcaaaggcttgtaaagtaaagtctgcactttctttagtaagactttgagtggaagcgcttcctacaggtacactcgcttgcacatgctgtgaaacatattcttttgtagtagtaccggatgatttactcattttgactggaggataatctaccacaactggtgaagaagagacgctaccagattctggactgacagttgaagatggtacaatttcttgatcctttgaaagtgcttcctttttctgttctgaacttgcgaggttagtagagggagttgccacttcggggtccggctcatcaccagttttctgttttaattctggttctggctctctcataacactttcgttgctaatagaattgacattagacagtggtgaggtaatttcagaaccatccttcttgagattggcaaaggaaaatgcgggagcctttcctgtatctttggataaggaatttgtgaagcccgaaaaaggtgaggaatctttgttttcaactgctgtggatttcatgaatggattggcaatattctccgttgagaggttagccgctttctttatcctatcggtaaaagaagcaacagacgatctggtgtcatcttcctcagtaacgtaagacgcagcaacaggggttgtgctctccgccgatgggaaagatccttcagtgagcagatcacctttgacctgcttatcatttcctttgtcttcttcttgctttttctcctttgatacatctttagtatcatctttcacttgttcttcatcttgcgcttgctgctccttctcctcttcctctccctcctccttttcttcttcttcttctccttcttcttcttcttcttcttcttcttcttcttcttcttcttcttcttcttcttcttcttcttcttcttcttcttcttcttgcccatctttggtctccacttttgcttgttcttcgttgctttgctcagcttcatcctcttctatgtcactgtttgagttcaaaacagttgaagaaggttttgaagaggcttcgatgtgtatatcagatctatcattatcatatatttccctgtcctctccgtataaggaatcactttcatcggtagaggatacaatgttagattcgatatcgtcttgatcttctgaaatgctcgaatcattagctggactaggcacttcagattgatcgttttcgatcgtcgaatcgctgacttctttcgaattcaaagaatcttgagtgacggatggcaaactgtggttagcttctgatatagattcaccgaaaccagtaaagttgaacgacttagtgtcttcttttttagaattcaagtggccgaatggatcagaagtctgagtttcgaatggatttatggtcttttggtctgtagcaaaggcagaaaatggtgaagacaatttcgcagatgtagcgaatgaattcggtgcagggttggtaacagcgctgtcgctgccaaactgagaagttccaaagagcgattttccaaaagacgactctgatgaaatttttgtgttggttccgaatggagaggtaacattagctccttgtattccgaaagatgtggagccaaaacttggcgttccaaagacagatgacgtctctgcctcttcggacaagggtgaagtggtattagtttgagattgggtaccaaatgatgtacttccaaatgttggtttgccaaacgctggtttactgggcgccgattggtcagatacaggttggccgaatgctggttgtccgaatgctggttgtccagacgttggttgactagatgcaggtttaccgaaagttggtggaccgaatgctgcttggccgaatgctgattgtccagatgttggttgactagatgccggtttcccaaacgctggctccccgaatgctggttgaccgaatgctggttgaccgactgctgattgtccagatgttggttgactagatgccggtttcccaaacgctggctccccgaatgctggttgaccgaatgctgattgtccagacgttggttgactagatacaggtttgccgaaagttggtagaccgaatgctggttgaccgaatgctgattggccaggtgttgcttggctagatgttacttggccaaatgttgcttggccaaaggcaggttttccaaatgcaggagatgaaccagatgacagcaaaggattttgagagccctcagactcagcatttgtactatccgtcatgttcttcggagtgaacgaaaaacctttagcgaaggaatttgtagtttcaaaaaatgacgattgttcaggaacctttcttacttcagttattgtgttcttagtgtcttggggagaaattaaagtaactttttccttttccattgaagaagaaccactttctattttatgagataagatttcgaaagactgtacatactgagttttggttggttctagcgtgaaactcgagttttgtaaagcagagtgatggaataaagcccaacaaaatagttccccaagattggtgaggacatataatatcggtagattgtcagcagcctctactccggaacaaggctcatacacagtaccactggaaaatacatctagggccatcccaatgggttgtgtatcattatctgtttcagggttgattggaagaattgcacaagcagcatcttggtccggtttatacatcacgttcggtgtggcaatcgatagctctgatgcacacgatgatcctataacgaatagatgtggtagctgctgagcgagttgatacaatgtttgagagtagtatgaaggatttcttttgactgttgaatagggaggcgcgatatccatggaaggagtaaaagatttagtattgacattgacaaaatatacggttaaatcgtacatgatatcttcttccgaggcatcgaccggttcgccgtacgatacgagtaaactgctttctgacaaagcgtttatggacaacggttcgttaggttcatcgagagatggcttttcaatagaggatgtgacgttaaactgttcatccagtacagctatagaaccatttttgtgtaaaacataaagttgatgtttcaaagtgtcaattgcgatgcaacctgtgattgaatgtaactgttcggaagaatgcttttgcgataaggatattttaaacacgacattagcgttactcgcaagaagtacattcccttggaaaattacagaacaaatgacttcattgacaccattaccgtcccagtattgttcccaggcgaattggtccaattcggtaacccatactgaaccatcttctaggaccgtagccaaactctctgccacaaaaaaaacgcccactactttcgccgtgaactctttcgtatttagagtgatgaaggactcatcacggacagattgcagatcatatacagacacagtcttggaagaagcaacagctagtaattttttcaacggatgtatggaagcattagccagttttgagaatggcaaatcctcattgaagcctggaacaatttgtttagagaataaaaacttgaatcccaagctctcagtagtttcaacattcaacgcatcaaccacagaggacgtcattgattctgtatgtgttcttttatctgtgccgacagtagtagtttcaatccgttagtgtattaatataaacctcagctgcttattaatttgtaaaccttgaatttcaatgggcatcagttgcaatgttcagtgcttgtacaggtttgaagctttttgatgatagctttgaagtaaacaaagttccaaaaagaaggaaattatcaatcacgtgatccggaaatcagtatgaggttagtgttcatgttttattgtctttactatgacatgaatgttttgagatataaaattttttagatggtcattaaagaatacgtatttagttaggtaagtatcttcgaaagaagtaggcgttaacattgtaattgaggccatatctgtaatgaaaacaaagcggatattgttgttctgaaaaaaaagcgaacaaaatgaaaggcaatatatatatatatcggtatcaaatggaacgccaagaagaatgatactttagttgaatgtgaatcatttcaaaattgataacctaggctggtgatccattggacaaagcaaaataacataaacttagaaaaaagtaacacttctttttaacacttgtgtaaaattactaagtatgcatttaagcagcgaacgatagagaccaacccaacttgtggactggttcagccaacttcaaagcgtcgaaagaagcaccaatacctagagtgacacctggtctcaatatttgttggtaggacaaggcgacgataccggagtcagcaaccttagccttaacttgagaaacggcgtccaaagcgtacttggaagcgaattcaatgttgacattagagccagcttgagggttcaaagcagccttagcaccgacttgcaagattggggaaaccttttggaagaaggaagcggtgatcaattgagcgttgttgacggacaaaccaacggaataagcaccagaagcgttgtaacccaaagccaaagcgtaacgggagacggcaccagcagagatgtcataaccaacttcagcaccaccaacgaaaccttcgtgagccaaggtcaagtcaccgacgaaggatggacccttcaacaaatcgaagaaacctctagcagcaaacaaaggttgaacaaagttaacgttcaacttagcagccttagagacacctggaacaccagaagtgatcaattcagtcttcaagcctggagtcaattcagccaattcgatcttggtgtccaaagtgttggcgttgttccaaccttgggtgaaagtcaaaccagtagacttgtcagaggccttaacttcaacgttagcagcaattgagccatcttttggagaagttttacccttaacagtgaaagcaacaccgtttggagcagtggtcttaacgtcaacagaagctggggtagcgtggaagaattccttgttcaacaacccattgatgtccttggaaatatcagaaaagaatggaggagccattgtaaatctttgaagttattttttgttagagggcggaagcaagctttcggaagtgcgattgatctaaatgtgaatcaattagagttcagtcaaccgctaaaaccaagaaggaactactacataacacaaaagcaagagacagacaccattttaattcggtgtgcatccaagatttttcgcaaatttcccaaaaaaaaatatctcgatctctttcatttatatataatatcgattttataaatacaaataatgacaatgtgaacttttctcgatttttcacagttttcaacaaaaataccgtgtagccagaaaatgtaaacattggaaagcacaaggcttcccaagtgaaaattataggggacgagagatttaatacagtgggaacgcacgtctatagtggggtagcggggactgctatacgcaactggagagtagctcagttttttgcctgaggtgtcgttttaagagcggatgtcggactaactcactttgagattctttacgcacttgctctcgagcatatatcttgtagattgtacatactgcatacagatatcaatcatttgaggctaaataaaaatggctatatacaggttattgatggaagtgtatagaacacgttaattggactatcatgttgcaattattgatagtttgggtctacaccccatgtgctttgtagtcttccctatttcagtttgtcttaatctatcactccggcactcttgagagctctacacaaaaaccgaaagaaaattaattaaaaaagagaccacgtaatgattgacaattggaggcgactcatttgcgccggatatatctggaatcctttcttgcattttgatttccgacttttattagtgctgactcgaagagacacgcagtgggaccggggtgatgacgttcgcatttagagtcacgtgaatatatcgctatgtacgcaacaattttttttttcttccaacagaattgtgtatgtgtgcatctctcctctttctagtttggttttcacatggcggaggcaagattctccacttggtgtgtagattttcttgttaaacagtcacgtgaatatccgagaaatcggtcctttgtctcatataccggaaaaacgaaaagttatcatgaaaactaaacttcgagaacaataattaggctttataaaacgaaattccactttgagttaacaatatgaaaatgcagtttcctagtagtagaaaatagttagatataccttgaaactgaaaatgatgtggtagtattgtcttttgaaatataatggcgaatagcatcacaccagtgacagttcacattcgctttttgacagttgacgactgcatctgtgtttgttttccgaagtcatgatgaaaacctaaacatctccctgttgccctctaatcctctgaacggtattcttgcatgattgaaaaatacgtagtgtatttttcagttcagaacttgtcgtttgagtctcaggaatatgtaccatgtagagaaatataaagcaaagatacattacattgtggaccagctcaagttttcttgacaatactgaggttacggaagatagtgttgtggatgaggaattacttttgacctgttggaatcaatcaaagttttcgaaagaaatgctgaattaattcattcgaagttcgaaaggatatttcacacctcactatcggagttcaaaaatacaacaggggttaatcagtcttaaagtattctttcagtcttagaataatgtccaagataatctttgttttgaagtacttccttggagctctcatggagtttagctggggcaacgtctgttgtattccaaaaaaacttgaaacggtagacaacaacaattgccacaaaaataccaactagagataatggtttattcttgtgaaaatatatttatgctgtgtagtatgaaattcatagcatatgctgcaagacataaccattagtgtttcgacctaaataaataaaggtttaacgatattctgtcgctctccctgctaaaaaaatctaagaatatcatctctacttaaaaaagctactagcgcacatcttacttatactataggctctagccagttaggtcgacaattcgctggtcaacaatatatatatatatatttatacaggaacctaaaagttgtccaatctcaattggagctgcaatcacgtgaccattcggactctgtatcttcttttagtcaaatctcccaaaatgacaagagcaagtccttctaactgctgccattcacgggagagaaagaggacatcttgggaataataatactcttttatttcgcatatttctatcccaactaggcaatcagatcggcactacagacttattccccagatcccaactattttgcttcaaagatcattgcttacaaaaaaagatggaaacccgaaattctcttttagtttttgtttctggtaatagttaccacaactttcttcaatagcctaacaacttaatatttcaacatatataagatacttatccattagaattaaaagtgtatgacaccaagaattattagcaggtgaccgaattcagagaaaacagatagtaacagactgcagttctagtgctatatccagttttgacaataatttttgtccgtcatttagttgagtatctaataattatcacataaccttgttcctcgtgttagtctgattttgataccatggttgcaggtttggggtcagaagatgacggtaataagatgatagtggaaacggaactggttcaaacggagaaacagaacatacttccagtatcacaacaaccttcacaacaatttgataagaatggcatcggcacagatactgagaattcgacgttaacgcaaaagaaactacttaataatacgaaaagggataccatgcctggctctccaacgagaaaggaaggtcacgatagaatagatacacacgatcttcacgatctccatgatgatatgagcgcaactctgaaaccacatcaaagtcagaatagaatagcatcactacagctgcaagattcaacacatcaaagtatcactagccatcaggaaaaagagggaacgccgttatcgcaccaacacaccaatccattatccactcatgcgttgtcatcgacagggttaaggaataagaaaagcagtttactcatcgactgtgctgtggacggggccagggacttttcgttaccacctcttacgaattctgatcagatgttggacctatctcttgtgtcaaaaaactcatctcatgatctgccctcgtttactacagcaatgtcaaagcagaaaactaagccccaattgagtaaactttcatcgtatcaagaggagtcatctgatggtaggattgattcggattcgcagttgaccacttcacaggactcgaaaactaaggaatgggagcggagacaaggaatacggacatcaaactctccgccgcctcaacagctggcatctcagatttctttgggagcaggtgatatgaacggcggaagtagcgcagtactgccatcatcaggcgtgtctcttcctttacagcaacagcaacaccagcgatcacaaacacaaggcttgaataatcccactgttcaggtccagtcagcatcagcaaatttgactccgaatgggcaaatatcgctgccaacggtcacagattcggaatctgtgcgaaaactcaataaggaatcttcatcaaaggccgatttttttgctgcccggttggcaacggctgtcggcgaaaatgaaatatctgactcggaagaaacctttgtttatcaatcgacggcaaattcagtcaaaaacgcttcgataaacgacgtatccgcaacaccgaataatactatcaactccatacaaaataataacaacaattctaagtcctatggtatccctgcaaagttaagcgctcctcaattgaaacagaacgataaactactaaacagattgaagaacacaagacacacaagtatagcagcaatccctaattctcaaggacctccgtcaagcaattctgaacaggatgatgtagcgtctttgagatcaatcaatagaaacactatgcaagaaatgcaatctatcaagtcgcatcgaactcaaatgtctgcctctcctaagaaacgtctcagtatcacttcacttcaaaaggtacaaaacaggcagcaaaaacagcaacctcagtctgttatcacaaatggagctacaaaatcatctacttcaacgactcctacaaaatctacctttgcctttgggcagccaaaaagcggaaaaaccacatcaagtataccaaaaaattccaaacaacacttcccgcaacctatgcttcctctggctcagaataaagtaatgcatcaaaatcacagaagaacttcttcaaaaccaggcgattccaaaaaatctgctttgaggacaagaagttctaaagtctttgatcctaatggttcctcactacgtcgttattccggagttcctgatgatgttaatttagaagactttgtagatcaatatgatggtgaatttgatattaaaatgcatagaccatccaggacaacggaaaagaaatcgaacaaccaacagcaccaatccaatgctgcttctcaacgtggaacgtactcctccgacaaccatattcaatatgaaccaaatgataaccatagtggatatggagatgatgaaatcgatttggataataacgatatccaatccaattcggatatcagtgatattcacggactgacatatcacaatcaaaccaattatgatgaacattcgtacgcggacgaagatggtgatgatattgagtcgatgttttactataacggaggtagcatagttcctaacaatgctagagttggaaggaggttctcagaactcgacgatggaacggaagatgtagaatcacaaggatttttctacggagatccgaataatgcagagagatcaaatgaaggaaagggacttggttcgtcccaattaccttatttcaatcaagccagtgagtatactcctttgaagaataaaagagtgagcaggaaaagatctgatttctacggtgatttttctccccacaacttttacaccaagaagggttcatggtctaagtttaaaaatttcgtttacttctctttcatcgtggcctccctattgactcttggattcatttctggattcctactggcaaccaacaaagaattacacgatttccaattgttggccatggataacgttctagtttcgttggatgaattagtattcgatatcacagcgactgcgtttaatccaagtctcttcactattggtataaaagacgtggaactagatatatttgctaagactaagcacgttgacgttagttcaaatgaagacaagttatattcaactccataccaaaccatactactcgggacagtatacaatctcgaaagtgaactacaatttagaggaagattgatcaacagaaattatgatgtttctgttgccagtgttaaattgctcaatcctggtgcacctaaaaataatggtgatgatgaagacggggataatgacgatgacgacgatgataatggtaacaaaaagaaaatgggccacgataaccaagatgaaaagggcaatcacaaactagagaatgatattgaccgttggaaagaattgatcaaatatgaattcgaattgatcgtcagaggaaacatgtattacagtatcccattctttaacaaccagaaagtactcccagtacaacagcaaatttctgtagatccagacaactcacctttcagaaaaaagcatggaaataaccatgcgcaatagaatataaaggccattttttagtctgccagaagcttgtttaagtcagacaccaagataactcatcggaaaacttcaaccttggccttacttagtttttacaatgtcttgtagtatgccacagcaactaatttgcttgtaattatatataatgataacaataagatatacttaaagtaccacaaactgtatttttcatggccgagttataagccttaagtgaccccagcaacatctgcatcaagaatgttatttatttacttctttttttaggacctacctgtgtccccaagaaaaagtaaaaaaagcagaaatgttgaaatactaagcacaagaagtaaacttgaaacaaggtaccgaaacagagctaaaagttcatttgtctgtttttatcgtcaaataaatcaactgctgtaggtccacaagttatcattgttattggcatagatttaaaccttcgaattgcacgccggtgggttttcctcgacttaccacacacacattcaaggcggcagaggggatattttgaacatattaacggggaacgattgtgagatcttagctactacattagaggatatttgagaaaagcttgtacagcaatttattgaaattattgaatattgtgttacttcaaagatataggaaaactaaagctggtacttgattatttccctagacgctggtaacccataagaaaaccgttcttatctcatcttgaattcctggccaaagaaattcggtaagaaacttatttggttataattatattaaacatttgatcatacttgcaagtccttttcaatacccaacaccgagcgatatggaggcaccgcagagaataagtacaaggtcacatcattcgatgcaaaataaaaattcaaagaacctttgtcttcgaataggtgattccccaacgaaaaacaaactaataatggtggattcaaaaccaaatgaaagcaatgatactttcgcagtgccattgcgccaccagcttactaaacgtgtaagtgaagcacagatatacactttaccgccacagcttaaatctgccagatccacaccctctacaccacaattaccgtctggcagttcgggctttgattcagccgcttcaccctcatcgtctacgtcttcctcgcctttcaataaaccaacacttccaacaatcaacaccaaatttcacaataggccgagggccacgacaattgcgacaagtgtacctcagatacagacgcccagtaatgattcaatggaaagcacgacacggtattgggttcttcaagaaaatacgcccatgtcctctacaaattatgataatgatatgaagagcatcccatacaatacccattctgatgaagactcaccgagctattcagaatcatacagagagaaatattatcccagtggaccgttacttgtcgtccctcctttcatatatttgtattctgaaccatcattaaaagaagtaatggattacgacgtaataataaacgttgcaaaggagattaccaactacaaggaacaactgcctctatccaagcaaggttgctattatcattttacttggtctcatacctcacaaattactaaaaacctaccacaactaacagaactaatacagaatgcctatgccagcaaaaaaaaggtgctaatccactgtcaatgtggagtatcaagatcagcttccttgatagtagcttacatgatgagatacgacaaattaagcttgaatgaagcatataataaattgaagtctgtcgccagagaaataagtccaaatatgagtttgttattccaactaatggaatgggaagattggcttaacaattgtgactcaatcaatgataactgtcggaaacagtcattcgagtccatctcggaattcggtgaactctctctgtgagattgtatgatataaaacgcaattttagggatacccatacaaagtatatagtagcctaaacactactctgtaataatacgccgcggatcttctgtttgggcaaactatcaaaacgtaccaagtgataattctgttcttaaaaacattaaacttttgaaggtttctaagttatgatataaggtaaataaagctggtgacaagggagaataatgcaaagaaaccattagataatactgtcctcccacttattatacttcggactttacgttactcgaaggattcattcagaagagtgcgaattatggaaaatcagaggccattcataactttcaaacctttctgaaaaaaccgagtaataaccatgagcgaacctgtcaaaaaaagaagcttgggcagttatctatctcgtctcgaagagagaagagaagaacgagaaagatcagagcaacagcagcgagaaagtcctaagccagtgggtgaaaatgggaattattctgttaccaatgttccagtaaaggaggaagaggtatctcaaaaggtaacttcaactgatcagaacagtacaaaacaaccatcagacgaaccctatgtcgttagccaagcaaacagctctgaccagaaagttggatctcctttgaataatcaagagtcaataccggtgagacaagcggaaacgaaaggacctattaatgaaataaaacaggaaacggatgtagaagaaaagaaaaatctaccgaaagtagggagaaataagcattctgacgaagaatatagtagtgcactcagtgaagttgaaagtgacgcaccgacagagcctgcatcgccaccaagaccaaaaatggggagactaatacgaggtgatcaacttgaaagcggaaacaacagtcgacaatcaagtgctccagtattgacaaatgatggggaatccgattctgatctttccgatttagatgaggctcgtacagctaaaatatcaagcagtgcgattcacgaagattcctctccggtgaaacattataatgaacacaagcgcaaatcctctagtatagaaaactcctccaatcacaagaagcaaaaacattctgccgggaaaaagataccgaagactaagcgtggagtacatagggatgccggaggcaggacaaaactacaaattgcttgtgataaaggcaaatatgatttggcaaaaaaacttattgaagaagacggctatgacgttaacgaccaagacaacgctggaaatacgccactacacgaagcagctctaaatggtcattcagcaattgtcgagttgctcgtaagaaatggagctaatgttaatattcaatcatatgatatgtttctagatacgcctcttattgatgcttccgcgaatggccacataaatgttgtaaaatatcttctagatcacggagcagatccaacaatggtaaatgccaaaggtctaagtgcaattgaatctattgaggaggaatcagacatggataatgatgatagaagaatagtgcacgatatgaaagatatgttaaagagagcaacgaggaaatatataaaacattcccatcgcaccttacagtctagttccatgtcaagacattcagatgatatagacaaacaactcaaccatgatgacgacttttattggactgatatcagttcaaaattgggtaaaaacaagcttttgaaagcttccaaagaggggaaattagcatacgtcggttcgtaccttgaaaacggtggtagacctgatttcagatgtttccttgagagttgcatatatggtcatgatgacgtagtaagtttatttttagcctttggcgcacaagttaatatgagtaacaaagaaggtcaaactccgttgatgctatctgtcgggcgtggacatgtcaacgtcgtgaaacttttactcgaagccggggcggatccacagaaaactgacaaacgaaagaaaactgccttgcattatgctaaccacagctctcttggtctaacggatcctgatgaagtgaatttactcaaagcagcggtgagggcaaaatatggatacgaagtttcaaacaacagcgatgaagagggggaggaagattctgaagggaaatctccttcacctagagaaatatcgtcaattccatccaccaaaggagaagagcaagatcgttctttggaaattcgtaaagatgatagtccttatcattcagaaccacaatctaaaatcggaaatatcaatgaggaaaagccaaaattattacctgattctcaaacgacagcagaaactgcttccctagtcaggccaagtctagagagactagactcaacaaaatcaacatcttcaacatcattaactcatcgttataaaagtgcatctcctacacatcaactatccactccgcctattcttccgaaagaaagcgaagaagagagagccgcaaggttgaagagcgaagaagagtacaggcaaaagagactgcaacagaagaaaaggaaagaacaggaattcttaaacagattagctgaagatgaacggaagagagtagaagagaaggagaaattgaagcaacaggaggaacagaggctagaacaggccaagaaagaggaactattaaaagaagaagaacttcgaaacagaaacgaagtagaaaaaagattaaagatcagagagcgttatccaattggattgagagtcattgatttcaaagatcttgagaattacgataaatttgggcctgtgtactacttcactgaagatggatcaaaatgggtgctagatcttcaaataagtgtcattatcaaatccagcaccgaagagttaaagaaacaatcatcagaatttaaagaagtggaaaagggtcagtacccacaactatggaatcttttcaaattcatcttcttatatggcggcagcgataatgcaaacaactcgaagtccttgccctggaggcaattgtcggaaattgaccaaacagagtatgtaaaattctatgaactcccactaacatggattaaactatcgcgattgaacctgcaagatttaaacccaaagatgaatgactggattgaaaaaaatatgatagaatttatcccggcatctacatctgccttgtacagaacaagaaaggtccttttacgtgatagcaaaagacctggccaaaacgaaaataatgctaacacacgctttgtccctgccaaatatcaatcacgctccaaaatgttaccatggttgaatgcctccaaagcgctttggtagggtcattatacatagcataagaagcttaacactgtaacaatacataagaaaagatagaagaagaacgtcttcctcggaaaatagaagtcacgtggattttatatacacgtgactcggacctttgcagatgattttccacgcccttcattcatcacttccccaacccgtactatgcgactgtctttccgggaacatgattggccagagtctgatttagtaacgttaaatccgaaaaaaagttccatctcgtatgaaatgacctaaaacacaccatcatatcataaaccttcgattctccttcgagataaacaatagagtagaaaaaaaaactgttaccagccatttttcttcgaagcgttttcttgttagcgttttttttttcggcccacttccgttggtgctattcaccttttataatggagaaacatgaaaaaaaaagctgtaaatttttcatataatttaaataaaagataaaatataaagctgattttagctagtttcacagatttgaacattgttttggtatagtttctctaatttattccaagggttttcttgtttgatattagtattcacaactagcggccaaagattttataaagagtatgtgcaccgtaagacgtaacataatcaggggattgcgaatgggaattttcaataaggaacaaatgcgaactggagtttccggagataatggataaaatcataagaagaacgatttaagagatgttctaattatcatcccgatgaataaggtggtatagtcatacctgatcaggtttaaagttttaaatggattggttgttttttagtggatttggttcctataagggtttttatccattatctgtatttggtcatggagaaagaaatggcattttgagaattcaacataataatgattgtaactcagctgtaaaagaagggatcatgtttttcaagaccagaattgatatttaaactcttacttattccacttgcaattatcgtctgatttttttcagtacaaagaatcttatttttactaacaacgattaaactggaaaatgatgggaaaaatatgttttttccttattgaatcattttcaatgttattattaccaacagtgttgcgttcctccgtttctagagttgcccgtgtcactcctgtcagatttgctcaaacacaagccctatctaaggcatctatcgtcgatttaccaaacagatgggaagacttgccagctactgaacaacaagatattgtcctaaagctagctgaacgtcaaaagctaccatggactgagttgactaatgttgaaaagcaagctgcttggtacatttcttacggtgcttggggtccaagaagaccagtgcacggtaagggtgatgctgctttcattgccaagggtgttgctgctggtttgattgcctctttgctaatcttcgctggtataagacaactatctggtgatccaccaaagactatgaccaaggaatggcaattaaagtctgatgaatatttgaagtccaagaatgctaacccatggggtggttactctcaagttcaatccaaataattgtgatttcttctacagtatagaatgcattttctccctctcttctattcagtttatttctattctctacaaacaacaagaacaaaaaaaagacacacagtcgatactcaccttcatgatataggagaagttcaaactctttctatttccaactttttgaatgggttgcgggtttttttgcgttttgttgaaattgcaaaacaagagctttcttcggaagcctaaacttgtcctttcgccgtgattttgagaaccaccacacgttagagaatcgaatttatttaatattattttattaacgaagaataacatatccttctatcaccattaaattaattcacaattaagaataaaaatcataccaaacatttgaatttgaaccctatgaaataggacttcttagtatcaacatcaagttttaaaaaaattgaatccaaaaatttacacaaacaatatccaaagccaaaaattaatgatttataaacggacacttatttaaatttgagaatcatttcacgtattctctttacgtttcatttattttatcgaaatcaattaaatacattattctatcattctgaattcgagaattcttttcttatccaggaaagattcattaacattctcacttcgaactatcaatccaacagaaaacccttagctatttaaatttgactagagaaaggctgtttcaaagttataagcatttcaacgcacggtatgtaacaggccgtttattctactagcatctggctcaaagcttgagaaggacgatcgctgacaggatcacaaacaggaaacgaaaagaaaaaattgaaaatgaaaaattcaatacagaaagcgcatctcatctcaacgcatatatttggccaatagaggaaattacttacagaggaagacacatgtcctcataaccccgataataatgtcctttgcatttggcttctctaacgaagatttcagtgatgatgaactagatattgccaatcaaaatacagatgataagccatctacttctgtccctcgaatcaatccattggattccgaagtgttactaggagaatcagtgaatcaacccaaatatattgatctggatgatctactacgttcactcgcgaatgtccgtctatcttttgaagaagtgcaaactccaacaacaaactctgttctttacagacgtgaactatttgacgttaaacatcaattgatgtcagaagtggattcaggcacaaataatgttgaattggagattttgatgggtgaaaccaatgaagatttgaggagaaatgtgtacgaaggtggtttgaaatcatgggaatgttcaatagatctagtagactcatttgttaaaaatccagcacaaatttcccagtgtcaaaatataatagagctaggatgtgggacgtcgcttccatcggaatttctttttatggaatatctaagatccaacatcaataccgggattaatttcacattatgtgactataatgaaagtgtgattagattggtatccattccaaatttgatcgtatcctgggcgaaaactgtgatcagtaatgaacaatggatagagctacaagcttctgaagattcgaacatcccaatcgcctctgatgaattacttctgacagaaaaattacttgaagctttcaagtctgatttagaatttagaaatgtatcgttttcgttcatttcaggttcttggggaaggaaattcatggatgttttaattgaacacaaggctaccccgttatcaaacaccttaatattaaccgcagaaactatatatcagcctgatacgctcccggttatatcagaaaccttaattgagctaatcgtggataacaaaaagaactcatacccggtgaaatgcctgcttgcagcaaaagacatatatttcggcgttgggggcagcatagtggattttgaaaactatatcgccaaaaggatagcaaccgataaccttccattatgtttaaataaatttaaggtaaatgctggattgaaaagatcaattgtactaatagagtgaatcgccacgtatgactctttttaaggcttgatcatcaatcacgtgatcaaaatcactttgtcgacattgtcagattcatataatatcgtgtaattcaatctttaaatatagcttgcattaagcgaatgagcatcagctgtactataaggagataactactgtacttagaaccccagaatggctcagaacgatccacttcaaggctttgaggattttctcgaggctgattttcagccattgcgctttgcaaacgatctattaaaagttacaaataatggcacagatacggatgtcttggacctgaagacgtgtgtgaagagatgctcgtatgatctccaagaattagacagaagaattgaaggtgctatcaagaccaacccaagccatgtgctagaacaaattgagaagagaaagaaggaaaaaagctttgtaggagatactctcaaatcaaacacggaatatttgtctatgtcgtacaacagattacaacaagacatcttagagccatttgaaagggcacttaaactgcagacagtttctagtaaaattcatcaaactacaacattactgagaagttccttaatatatgtgcacatgatatctcagttgcaaatgatgccattagagacagactctactgatgatgagcaactagcatgcgggttaaaaatagctgccttacattcacaattgaagattaatattgaacaaaatcccaacctggcaactttgcagctgataaaatcatgcgagaacaatgtggtttctccaaatcgacaggaattattgcgatatctttccaccaatttgacaagggattgtctaaacaatctcaagatggaaaacaaccctaagagaattgtgactttaatcaaagcattgtatactttatctccagtagatctttttgatacaattgacaaagtactcagttcaaaaattcaaacgacggctcaagtgctatctaagaccatcacatccattagaaacttcaacctgtcattagatgatgccatggaaaatagaaactcgatactcactttacagaacttaatggaagaatgtgagattgaaggaaatacgaacactcttcgcaattacctatctcaaaggaaattttcctcgttgatcgatcaattttggtcaaaagtcactaatagtttcaaaagagatttcgaaatgtcctacaatcgcggtggacctgtcgggaaatctctgcaaagcaattccaatctaatatatgaagccattagtaaatgcttcggtgaaaatgaccctagtaatgaactacaaggcgaactgcagtatatcttgaaagccgttagtatattagatacaaacaggaaataaaaatcaggcttatatttgtatatatagagtaacaagactggtcctttatggtttagccttcgccttacttatagcacctgcatctgcaagggggttcgtagccttctttttgtttttctttcccccacgcttatggaacttcttctttagtagcttctttatctctgaatctctttgcttcctcagatcttctctctctttaccgtgtaatcttgccattctctgccttttacctggcctttttctccgtaaatgcctgatacgaacctgctctgtgtggactttacgattatgctcatctacatctattacttttcctctgaactgaagccatccgggatacggtcccagctcagcatattttaatattacatctgcagacactgcggctgcagaaaagttatgtctgtcctgctctgaatattctgcacagtaatacgttcttgctctacctattggagctgagtctggactcggttcacgaaggctgacctttattagggccgttgcctttctacctctgttttcatctgtctgtacactttcgccaacatcattcgcgggggttgttgaatcggtaatggttccaaaagagaatagtgggaattcaaactcttctgcggaattgttaacatccgattcatcatttctgtccgactttatattgtcttcttgttgagtttgaacgtcgacgaattctagatcaagcttcggcagcactacacgatcatcagtcgctgtaacgttagtcgtggtatcaaagagctcatttctcgaaacaactctcaaaccagacatgattgatttgttgagctttgcaaggtgttcctgagatgatgatgaaaagatacgcagattacatctcatctcctcgtatcgtcatattttgactaactttttgatcttatatatacatgtatattttttttagcatattggcaataggtgtaagatgacagacagtcgaaagtagccacagatagtttgtaatgacaaacatgtattcttatgttatacatatcacttgtgtaaggttgtgtgcaaagtaagattttgctatttcatggtttcaatatctacataaaaaatggtatgtacgcaacttggaagcaccttttaaacttacttcgagattcttgtcttcatgttttgtaagaattctctgtagttccagctgttttggaccttatcttcgaccaactgagatgcagtccataatcttagagaagcaacttccctggcagaaggatggttcattggttcacttggtgaggcgcctctgacaatgtgcaaggttttgtagaagataacatcatcgtgttctcttatctttgtaataacattcctcactcttaggttgaactcagtagcgtctaatagaggtagttcatttttaccaattggaatttccataatgtccggggttccaaacacgtctgtaacaagctctgggacagcatcaccgccaatccataagaacatgtccaatcctgtgtcgattaaatacagaccgtatctttccaataaagacgaggtggagttaattggttgcggtagtacaatttcaccagtttcttcatcgggaagaccagcttcgtcaggcatgtcatgtaaggagtatactgttggataaatgttttgaatcaaatatggcaatggtaacgtttcaagattatttaatgcttgagctctgtgatcagccggaacaataccagaacggaaagccatatgtttagttagagaatgcatcaatagaggccacattcttaggttactacagagcattaatggagctccgccacctgtgtttgaagtcaaaacttctttcttgtatgtagccaaaacctcttggacagatttgttgaaaaattctctagtgtcttcaaagccagaagaaggagctctttccacagccttttgagcgaagtatgctgtgatggccaactgatctgcagaagcatagacttcagttagcttatcagtagttggaataccaatagttatgactctaattcttctttgggcagcattggatgtcaataataaagcaatttgaatgtacacaaagtcctttgttaattgttcatcgataccaatttcaaaaacgtatgattggtcccttggaaccgtagccaaagcgcacaagtctgaagatctattgaagaaatgaccgtaaaatccggtcattttcaagcctgacgaaccacgagctctcataacagcttccaaagatagatccatggatacgtgttttgaaaattcttttgagaactttgtaacatcgatcaagtttaaggcactgaaaccagggtagaaatgggtttggccaccagtgaaacggcctaggttagagatagatgcgatatcgacataatcgtcggaagccataaacatatccaccgtaacttgatatttgttacattcgatagggaaagatttgtagaatgcgtcaccagtgttcaataaagtggaagcttccttggaagtatttgcaacagccttttcatttctcttatgtaatgtaccttcaccgacgttggccaaagtggcaccaacaacaataatcttaccaccctgagctctgatcaagttcaaagcagactttagagcagaggccaaggcaaatcttggttgaatattttgttggaaaatttctggtaagctagtcaataatttttcaatgttgcttctagcctcaattagtggaaccaataggccagtgggagaaggtaagaatggttcatccaagtcagcgacgtcgtacatcttaatgttgtcaccttcttcgtccaaaggaatacggaagtaatgtagagattgatcaacacaaataatagagattcttgttctctcatcatggtttggaatggtatccaagctttccaagagagttcttgcagcagtagccaacaagccattcttgattgatgcctgagaaacgtccaaaatgaaagcgtaagtggatggtggtggtggtctgacagcgtattctttaggagcaacgaaatccacaacagaatggttgaattcgggtctctcgtaacggttaccattcatatcaattgcttgagggaagttgttcgccaagttacagaagttacatctccaacgtaaaccattctcgattacttgtacgaaggggttcaagtaggcacgacaacgtctacaacgaaccacaacaccgtcttcgctagttggcactggacattcagagtcggttaacttagtgtatggtctgataaccatagctaatggtagtttcgattttttcagtaaagaattgttttttggaacggcgttcaaagtgcaccttaaatggtcagaacaattgttaactgtatcgttaggaacaatcatcttctctggagggagcatcaacggtggtggaggcaaagacaagtcagtgattggaggaggcaattcttggaacaaatcaactgggtacaattgattcattggtttacccacagccattcctactcctggttgttgatattgtggttgctgctgctgttgtccgtacgtttgcccatacggctgttgcattggctgctgatactgctgctgaacaccggatatgttatcggcgccgtagccactgttcattggctggccatattgaggagccccaccgtatggtggttgttgcaccggggttccagcttgctggaatgcagtaggatcaaccacaggaacgttgtgtaattgcatattaccaatgccgttacttgcttggtcgatctgttgatgcaaatgttgttgagcaggagtcagaaattgcggctgtccagcacctacagtttgcggaggaacacctccaccaacaattggctgtgcaatcccttctgcaatttggtactgagcctgaggataaacacgcttcttatggtgtgacatggttcagtataatttgatctcctgtatcactcgattgtctgtaactctttctcttttatctgcaaaaaatacaatgcaaagagccttctcctttataaacttctgataagtcgcctagatcctgacacagttattgactctaccaagttgaagatccaaaagagtagatgcctcaatcgatggcaattgaatatcaaatgtgtgtattgtttttataattttcggcccgttttgttattgtcgaagaatcgaaatttgggtttttggatttttgaaattttttttttatttggtttcctttcaagataactgctaaataaactgacgcggtttgagaggctttttccagcgtatgtatatggttgctgctttattagccaattgctcagtcgatgttagctacatatattgtatttctttgatcattgacatatgtgtattgtatgctgcagttcgtatttgtatattgacagctgtcagattttaataataatattcgggtaacatcatagttcgtgttctctcagaatcacatagttaagtaattaatgtcgacgtggtcattgtagaagataaaactttcgggcagattgtgggtcactgatactccctccagacactgtacgggctttaacgaacctacctgtggttatgcagtgctttatttgttgatggatatttagagatataaaccttgctatatcacgtgatatgaaagttcgaggtctgcttattttatttacaatgtgcgtagattttggatcagatctttaaacaagatgtctcgaaggtaaaacgattttaaatacgagcaatccatccattgttcctagtattcgatatcataaggttctacactggtaattcagctaatacctgtgactgacactcaaatctgcttctttttcccactggtacaccatagaatacccttaattaaatcaagtgatgtcccaaatccaattttacaacatcaagaacggagaagaggttcatacacccgcacttattgtccacggaaatataaatacaaatgccaattctgtccaagtgcatcattcgcagctccctcccttaacgtttcccgttaacaaccacggattcaagtgcattatttctttgactcctggtgaaaacttactatggttcactggaaatgacaattctacggcgcaattaactattcaatacgtaccattgttacagaacccgccaattcatctatgtctactactcgctaaagattctcctctgaaatatgatgcaccagctgtacagattcgtaaggagggtggtaacggtctcgatttggccataaagaaattgagaactggtgcacggatcatgcaagctttcactaatgaacaaatggttcgtaacggcgtcggtcaaagaactttccgattcgtggaagaattcacgaaggataccctcctaaaggatgacgagttaagaaacaccgttaagattcatattctaaaaagtgagaagactaccgtggagctaagagatattaatatcgcacaacagaatcctaatgcaaaagatgcaggtggcttatttggtatagctatgaaggaattagaaagatatggtgcaccatttaatgacaactataacacttctcaagctgctgtcatgttcatggatagtcattgggacaaaaaactgaaattgattactgcgcatgccgctctcggtggtggtacaaataagatcaaacttgcaattttcggttcccatggtctgtattcttggcctacttgctttcaagacattgttccttactttttagatgataccagagcaagcacctctgaagtagccaatgattgtaaccagtgcggtacccactgggaatgtctcgcaattacactaggtgcattcatgcatgaaataggacacttgctaggctgtccacatcaagaaaatggggtaatgttaagagattacatgactttgaacagatcgttccttaccaaagaagcttacagtttaagaactaattcatatggtgcccaatctccaatatatcctaaactcgaatgtacatggcacagattggatattcttcgattcttataccatcccagctttgcactacctcaagacttttatgatccgcaattattaagaccaggtcagctagatcattggaaatatcagaaggccaccttgttcccgatgggaaatcaaactgcaagtattaaatcggaatcaggtatctactgtattgaaataatatgtggtgagttcgggaaagcccacttggaatatctaccaaaacaacatggtggtgtaggaccccaaaaggaaatcttagttactctggatcagctgcgttccatgattcctcctgctcaagttcctgagttcggtaacaagttcaatataaaagttcactccattaacgctgctaccgctgaatttaccaactttccggagataatcaatgttaagccaatttccatgaaagaatatggtttcggaaataacgttctaggtgttaaatctacactattaggtaacgccaaccgtggtagtccaactggtttagttccaattaaagttgagcaatgctacatcgtgcgcgtttatcatggcgcagctttagatggtatcagattttatgctaaggacacatcagaagctcctcagattcctccacgcacttacgccggaaaggtgtctagcatatttaaaggtgcaaaagatgttatgacaagtggtccatcagtattatttgggaaggagactgctaattatagtgatctaagactggaatccaacgaatatataacaggattcaacgttagagcaggtgcttggatagacgcgatccaggtaattacaagcaaaggtagattatctgaaatgttcggatcaaaatctggaggttcattgggaacactaaccccgcctccgaataagaaagtcttggcaatatacggaaatgtcagcagttgggttgacgcagtaggaatagttttcgaggcttgatggtcaaatacgataaatcattaaattacaactaaggttgacgttgtagtctgtaaatacttgatgcagaagatatttaaaggagtgttaaactattaataagatctcaacttgtatgaggggacattgtttcactctgacttctagaaagagggggagcctgaggtgtagtgtcactctttgatttttcattagtagccaattttgatagcttttcatttaacttatctaattcaatcgagttagctagttccctaggagaaacacttcttttcaaaattccaacatggtctgagctatggttacgagacattgtcctggccaataagctgggatttgtccgatatggtggaagttgtctagctgggtgaacagatctagaggcacctgacatatttgtggaggaagagtacggtagattatgtggcaaccgattcgaagactgtcctccactgctggttgttgtgaagctactgctatggctaacactcctggactttccgctggtggcagaggatggagcagtaggtatgattgagtatcttctttcttgatggactaaaccgacctctttaaccttagttgtattcaagtcagtatgtggtaccttagaaaatgtgtctgtttcttcgttatattcatatagataccagcttacaccatatggtttgggctccaaacagtacacggaatgtagggggacatccaaatttgtaataacgtccttactcaagttcaaaaaataaccaagtaaaactcttgctaccactcgatgcgtgacgattagaagattatccgtaattctttctatttctgtaatcacagggcgtaacctgttaataacatccatataagattcacctccaatgccaggatatctataccttaacttgtctagaagcctttcttcatattcttcaggagagcgtagcaatatttcttcgtatgtaagcccatcaaaatcacctgcacttaactcatctaacattttcatttgtttaatgtcaaaatgcctgtcattaaaagtgcatgcggtagccatagctctttttttcattgatgtccatacaaaaaattctgtcggcgtaaactcatgtttggtatcttgagtgcaaactttcaagtgttctttcatttgattctcattgaaaagctttctttgttcctccataaacctggctaaagctcttgcatatttcaaaccacgtttagttagttgagaatcaccaccgattttaccagagacgttaaattcactttcaccactccttgtaatccagatttgtctctcagcaagattgaagtttaatagatagtatactgtttgtgaagccaagaatccctgtatatcataggaaacaatttttttaccaatgtcgatcatcttgatgtatggaacattttcatcgtcttcgatggtctcatactttttcatataattagacaatcttcccttgaaatctgataaagatgactcaggatctttccccttataatctggtcccagtagtttcattcttatattcttttcgacggtctctttatccgaacaaatactttctaggaacaaaactttgatgaatttatttctttcatgaatctttttaagaatcatcctacgcctttctttagtggaattagttgcatcaaagattccaactgagcctgggccattcaataaatattctaaaagttggtccaaagtgtcaagagcccatttattccttaacatcttggaatgctcgtcgtccggatcaaaaaaatttgaatcctgttccttcatgttatgttcttttgcaaattgccttctagtattacccacattgaacactttacaataatacatggaatagttcaagtacctggataatttatttgtaatgaacgattttcctgtcgcaggcaacccgaccattatgatgatcaacttggaccccggatccttttgagatataataccatcgggagaagtcttagattttgtcaaccccggcacatcgatagtggtgggcctccttttcggtaccatatgagacggtgggtgattttcaagcatcgactggtcctgccaatcttctgcgccgctttggaacccattctcggaagaaagttgttcttcagtgaccggtcccaacacaggagacccagttggtgaagtgctccttgaactttgaggagacgtctcagcagaagtctctactgaactactgggagactggaacctagaaacaacgggcgtatcacttaaaggccgcttttgaaactgaggtaaattatcaacctcgtagattccatcctcattctcatccattttcaattgtgtcgcttgatcatgtctcttatcttcgatggactgtgtaggttccaactcggaatctgaactagaaaccaaaacatgttcagagaacgaaactcttctaaacatatacgaattggtaaatctgatgacaggatcccctaacaaaatctctagttctcagagcgaaaaatataaacgctagaaaattgagaaaaattaacggagaataacgttaaacctgaacgttgaattcagtttactttgccactgagctgtagtactttaaatgctaaaagcttgatcctgcccttgtttagggttccatgtttctgttacatcattcctcatgtgatgttagaataaatcatttcaaattctaatttcaacctatatataattttaagggaagaaaatcaaaaaaaaaaaaaaaatgctatagttaggaatgagcatatgctagcttccttgggtcaaatggatttttgggcctcgaaaaacgagaggaaaaagtagacttgctgacataagggacaaactaaaagaggacagacaccaaaagggaagagagacaaaaaaaataaagaaatcacgtgatatatatttctctcactcctcccattctctcccatactgtctcgctcatcttactttacctatttcatggaaaacgtaaacaaaatcagaattcgtttttgatatttagcattacgacaatgataaagcgggagctttagtgttgagatcaattgaaggcatagctattggcacagcaggtcctttgaagagagttttattaggtaaagttttgatttacaaatctagaaactgttttagcaggatatcccagttgttcatcagagtttacggtggcagtgtgttcaaaatattactcaaaaaatgtcatttctacagaacttgtatgttgtaagattgttatttgtgtcctctttacaaagtaagtgagagcggccttgatagttttcaattattttactaacgttgaggtttctgcgatttttactcgcttgggaactttccatatgttttcagtcatttgagtccaggtcagacgataaaatcaactcgaggattcaaatggaatacagccaaaaatacgaataaagatgggaatggcaatggtaatacaaatggtaacggattccaaaatgtaaaccttacaaacgacttgagtttgcctcaatttaacgataacatgccacaacagctttcaactcctcagaaacaggcaactactgcacatcttttccaatctggactggatcatggtgctggccctgttacagatttcaattacacaccgtcgcatcaaagaccttacatacagtcaacttcgggcaccgtggtgtcatcccatcaggacttaagacagatcgtggagaccactttggggtccaaaggtgttttaaaccaggctgttaaattacctaagggcgaaaatatcgacgaatggattgctgtacactgtgtcgatttctacaaccaaatcaatatgttatatgggtccatcacggaattttgttccccacaaacatgtccaagaatgatagccactaacgaatacgaatacctatggaacgtccatcctgggaaacctcctatatcgttaccggcacctaaatacgtcgattatcttatcagatggtgtcaacagcagtttgatgatgaatcatatttcccaagcaaaccaggtgccccattcccaaaagatttcaaagactctatcgcaagacctatcttgaaaaggctatttagagtttacgcccatatctactgtcatcatttcaacgaaattttagaactcaatctacaaacagttctcaatacaagtttcagacatgtctgtctgttctcagaagaattccacatcttaaagactaacgactatgggcctttgcttgaacttgtaattgaatttaaagataggtgagaacgaattcccatttaaaccgttcaaaatcaaatgaaaatagcacttgaaatgatggttcatcaaatccacattcgtaggtaacatatacatattttgtataagcatcacccgccttcctttttatagtctctcttattttaagatctgtcgtgtctatgcggataactccggttcagtttcaacgataaggaaactcagattgtgaacaatcttattttacacataaaagatgaggtacaatatatgaaaatcttgccttaatgtcctgatataaatatattagcgaacgttagttacgagttaaacaagtcagccgcgtgtcctgggctacttttcaattgatatacaaacaatgaagctggctgattttgtcacgtacgtgttcggcagcttactcgcaggattggttacattgaaagtattgtcatccttcataccaagtttgctagtaactctaccagcgaaagtaaggttacgtgttaataactcacttctaaaatgctcaaacaatttgaacaggattcctgtgctggattttggttggaagaactcctctgttagaagagcctttattttagcttctgaaaggccatcggattatacaaacaaaatatatggcgatagggttcatatagcatacaatgatagaataaagagagagtcattcgttaataagttgggttttgattcaaagcgtaaactcttagggtttttccatccttactgtaacgctggtggtggtggagagaaagtcttgtggaaagccgttgagacatcgctaaatcaggataaaaacaatatatgcgttatctataccggagacacagatgttaatggatcagatatattgaacagtgtgcggagaaggtttgaatacgatctagattcggacagaatagtattcattttcctacagaagagaagactggtagaatcaaaaagttggccgaaatttacgctattaggccaagcttatggttccatcattttgtccattgaagcgcttactacacttgctccagattattggatagatacaatgggatatccttttgcttatccctttgtatctttgtttgctaggattccaattgtaacgtatacccattatcctgtcatctcaacagatatgctacaaaagctaaaaactatgccaggatttcacacaaactttaaactgatcggtaaatatgtctactggaaaatattcatgctcgcatacaaattttcaggcttatttgttgaaattgcatcgactaattcaacttggacttataatcatattaaatccatctggtcctcaacaaaaaatattcacattatttatccaccatgttccacagaatcattgatagaaggctgtgacaaatcagatccagttaaaagactaaatcaagcggttgttattgcgcagtttagaccagaaaaaagacacgaattgatattatcttccttctcttctttcatcgatgctacgactaagaaagatttgattcctaaaataatatttataggatcaacaagaaacgtagaggatagggaatatgttgaaacgctgaagaagtatgcctttgaggcacttaaaattccaacccatttagtggatttcaaaactgattgtaaatatgatgatatgaagagtatattatattcttcatggtttggtataaacgcaatgtggaatgagcattttggtatagctgtcgtggaatatatggcaagtggtttgatcccattatgtcatgcttctgctggacctctttatgatattgtagtgccatgggattcaaagaagaatgaacaaagtactgacaaagctaatgaaaccggctttttcttcatcgatgaaactgatccggattttctagccaaagattcttcaaagtatagttctttacgcacgttatttgctcaggtatcgaaattgaatactgtacaaagaattgatatctcaaatagagccaagatgtgctctttatcaaaattttctgattcagagtttgaacgttcatggaacgaggtgttggaggaactcaatttgactcataatagaatgttcagttgaatttgaattatataaattgttacattacttagacaatgaagtaaagctatagatgtttcgatatcagttcgtatatgcacttgctttgaaaacatgacatcatacttgttacaattttgtttcggaagtattagcagagagaggtgacatggtgccattttggcgagattactacacgttattcttggcagaattttctaatgaatattggcctgatttacgaggatttttaggggttaaaaactgcgatgctttgttcattggctcgatattagagttgttcaaagtggtgttacctgtagtttcagaaaaagcgtgtatctcgttttctgtccttggggttgccagaatcgagtcattgttgtcaacactagctctggctgcttggttgccttgtggtgtagagtgtgtcaataccgatttattatgtgagccatccaagttcaatttttctgtgacaaatctagctttttccacaggattggaggtagaagttagctgtttaatattgttgaaccagtccatcatagattcgtaagaatctgttctgaaaacccaattatgacctctgtggataatcccgttttgttttgtatgcaatataaacttaaagtctgaagatcctttcttggaatgttctgcaacagtacagtcattcaaagacaacgatattacgggaatcaagtctttcttcctatcaccggatttaaactcatgcaagaaacttggagttaagacatagaacccacgagaatatgatttcaagaatttggatcttctttcgagaattccagatttaatctcgtacgtgaatggatcattttggttcttgtaaacaatgtctttgacacgtctcattggtaagttaggatcgatgaaatttgggtccttagcgacaaagttttcccattcaaagacaggatctttattgaaaaaaccagtgtccaatttggaaatcaaaacgtcaaacactatctgagcttcttggcctaaaactttagcgtaactggtcaaagcgttttgaatttccatcataacaactttttccaactccctaccagaagtttgtaaattattaaaagcttcatgcaagaaattctcttcggtcaactgtttcttgatttgtttttccaaaaggatcttcgctaggaaaggatcctgtttcacagatccgtatttagaattttccaacgattcctggaaagcttttaaacgaattttggtttcctgaagttccttgttacatgaatttttgaaatctgactctaaagattgaatttctttaattttcaccaatagatcacgtctcatatcctctaatctggggatcacatcttgactcaattccttggaggcctttgatgctgcatggaccatttgcgtatggtactgattaaataaggtgggtagatcctgaatagatccgtgccctagaggcaaaaagaatttttgaatgttcttgtcctctggagtggtaggttgatgttggctatcaatggtgaaaaatgggaagttaattgcatgctgcaatctcaaatgttgtcttacaacttcatcttggatggaaaccgtttcttgtagatatacaagaagtgatctgataatacctctccatgctgcaaatctctgagagagaacttctgtagggttcgcattagtaggcatcaataccaccaaaggagatctgggatcctgaccgttggacctatgtctttgcaatgaagccctgtttctgctaacatgcgtatgcgagctagtcaacgaattcgtctgctgctgtctcttggaagaattcatttgagggaaagaaattccttcttcaagaccagttgcatttgcattcccttgaacgccaacaacatccgctgacatggatcctcgcggttggttcacatcgatagatatgttatcggtcggataaggaattgtctggccagcaaccgaaactctgttgttagcgctagttccattcaatccgctttgctggaaattcttgtaatcagcagaagtcaaacttctagatggttgctgttgcagctgctgcaattgctgcaaactgtgttggttttgcgaaagcatatcggctatactgctagtcatagtgttttgtttggacatcttatcactcgaaagcacaaatcagaagtaaactataatgatgatgattatgatgataaagtctgcgatagcccggcttttctcttttttttgtagctaaagggctcctccttctttattccttaataactactcaaaccgtaattatctccaaagtaccgaaaatacctcgccaggagaaaacgctttctttaacgttctatcgtatcagtttcttaacaaagggaaaatggaagcacaaatccctagtattgtactgaacttgaggtccttgcaaaatttcttaaataattcttcccagtttcaattttaattgcaatttcaaatttttgttatttttaaagctgggctcccaaaacttcctctaaatattactgtacttggtgattactacagcattttcttatgattttttttttttccattttttgcattcgatgcttctgtgagataaagaaaggttcaatacatatggatggggttggagaaaggatgctgtggatcctggtggtgtaaagcttgcagataaggggtgtgaaaagctaggacgaagacgtcaatggcactgtccaggatagatctgtgggaagaatgatatttagtagtatatattaccatgtattgacgtttggccctgtacagagtgatgaggatattctgcttcaactgaatctccttgtatccataggcattttttttgttacgtgtggcatacgtcgaaatcaactggccgaaatggacggtatagtagaagtcctattcggctaaaccgtctcttcaactggatacctgtgttctgctctttgtcatgttttcagccacctctttgaagtgttgtgtgtaacacctgtgtgcatactgtatttgttgctactggggttcctgcaagatctctgagcgatttctccgatcacacagttacctcttccgattaatgacacgtgacaccgaaatatcgttttccctttctcagattttgtttacgtttcgttcaatatgactattgaaatctcgaattgagtaaagtaatgaatcaagtgattgacatatcagcggatcagcaggcaagggactgatatccaaagtctttactgtacccccggcgaatcatttaaattcaagagcagaacgttactgttccaacattattcaagaaaaatagctctggaaagctactgtgggagtatctctcaatgcagtatttcaccaaagatgcgtccatggtgtatacgtatgatgggatacaaaagacgaacgcgggcaatattaagctgcgacgtttgaaaacatcatcgatatctagattgttttcaaggagcaaaactgcacgtctgcgtaacagaggcacaaggaacaaacaagcaaaatttgtagggtctgatttgaataaattagagaggttcatatattcagagagattcatgccatgtgtcatattcgttatctgtatagtgacgctactgcatctgatacttgcccggctgattaatatgtttcaggaaatggtcaaatattatttctacgcgaaccttttcggaatgggctgggattggtactcgaaatggaactggatagttttacatatacttgagaagttcgtatagcttcatataatagatcgcattaatcgatgttctctcagtagttacagtgtctcatgttaagcaccatgaatcatactgtagtatcatatttaataaaaggcattatagtgcgaaaatgcttacaaatgaacgtcattgtttccatcctaaagccgcttaatacagcttaatgaaagaacatacaactgacacagactcgtggtgacaattttcctcactttgatctgagaacatttcatgtttatatttattccatcttatttgtcccatgcggttactctatgtgtcaaaaacacttattacccggtacacaatatgaattgacaaagggtacatgaaaaaatgtgtcaatctgagcttttgcttcttgaaatatgaacgaatgttaaaaaatctccggtattgcacaatacatactatcttctcattcatcttggcgttctttcttatattgtacttccattttgagtttctcttttgaaaacaagtgcatgcacgtactggctaattcagttggctctaatttgtcccctgttacccctatattgtggaaactttaacaagagctttgtctgtctttttgttttaatattgtgtgtgtgtgtttttttttttttttcattaatatctaactactggagagatcgttttgaggttgaccaatatttagtcaattgtgtgtcttttacctaatttttcaagcggttccatcttcggcgcatcgttaaactcatccctgccaagtgtatgcttttcaatttttacaataaaacttcggctgcttgtaaatctttacccgctaaagctttatcgaacgttagatatttccaaacctctcctatatcgagaaaaatgccacttccacctgttcttgaatcacgtcgtcccaaagaatctccggaattcgactattctacactttccaattacaagtctttcaaggtaaagcattcacagttggatgttagcgttgatttcaaaaagaaaaccattagtggttctgtctcttacgagattgaaaaggtgaagaaggatgaaaacactatcaagttggatacttcttacttgaagatctctaaagtcaaagtggatgatgaagacgacgtgaagtttaaattgttagaaagaaaacatccattgggtgctcagttaattgttagtccatcttctttgccggaaatattccatttgtgcttacaattttcgacaactgcagactgtacagcattgcaatggcttgatgaacaccaaacatctgggaaaccgtacgttttctctcaattggaagccatccatgcgagaagtctattcacatgttttgataccccaagtgtaaaatctacatatctcgccaacatcaagtctgaattaccagttgtgttttcgggtatccaaacaggttacgatgattctactaaggtctactctttcaagcaagaagtaccaattccagcatatttgatcggtatcgcatcaggtgatttggccagcgctgatattggtcctcgttccaaagtttacgtggaaccttatcgtttaaaggacgcccagtgggaatttgatggtgatgttgaaaaattcattaccactgctgaagacatcattttcaaatacgaatggggcacctacgacattttggtgaacccaaactcatacccttatggtggaatggaatctccaaacatgacatttgccacaccgactctaattgcccatgataagtcgaacatcgacgttatcgcacatgaattggcacattcatggtctggtaacttggtcacaaactgttcctgggaccatttctggctaaatgaaggttggacagtgtatttagaaagaagaatcactggtgctattcatggtgaagctaccagacatttcagctcgttgattggttggaatgatttggaaggttctatttctgctatgcagaaccctgaaaggttcagttgcttggtccaaaatttgaaggatggtaccgatcctgataatgcattttcgacagtcccttacgaaaagggctctaacctactattctacctagagaatctgttaggaggtaaagaggtatttgatccatttatcaagcactactttaccaaatttgcacgtcaatctctagatacatggcaatttttggatgctttgttcgagttcttccatgataaacgcgagatattggaatctgtggactggcaaacgtggctctttacccctggtatgccacctaaaccaaagctaatcactgacttggcggatgatgtgtatgcattagcaaataaatggattgcaagtgcacagaaattcacagaaagagagcaattcgaaaaggaattctccatcaaagatatctcggagttttcttccaaccaaatcgtcttgttgctagacacactagttcaaggtgggatgccagaaaaggatactttcaaatggtccaactaccctgaagcttctgaaatcttcaccgatatctacgaagataagatctccaagtcccaaaacgcagaagttatctttagaaactacagattacaagtgaaatctcacatcacatcatcatacccggaactagcggagtggctaggtactgttggtagaatgaagttcgtccgtccaggataccgtttattgaacgaagtggatcgtgagttggctatcaaaacgttccacagattcagagactcatatcatcccatctgcaaatctctcgtaaagcaagatttgggcatctaaatttccctgaattctatccataggtgtgtcatcagtattatttaaaaaaactaaagttacactttcatacctctctcatcaatatatcgccattcaaggctgtagttcttttatattccttttcacgtgacttctcctttttgtaccaagaatttctgcttatgtgttgtcatctttgaaaaaaaagtttgaatctggattttcgcattaaatcacatatggagatcattgaaaagaagtctaacatgttaaattgaaaagagttttggactgtaacagcagcagatcgagtgtgaaaatacccaagcttggcgaccatgaacaactttgctcagttatccgtatgtttgtttttttcttttatgttttggcgtaagttttgatcacacgttaaacatttttgtttaagggtttaagacaatgaaataatataattcattgtatgttattttaagttggcatattcagcatactaacagttttcatcttgaaatggaatcttctctctttagcaaatctccagttttgcgcagaacttgtctgtggaacgcattaagagcgaatttggttctctacaaaatagattggcgtcggtacgtccaccacaggaattcttcgacttcaagagaatttccaaacctcaaaattttggtgaagttcaatcgagagtgggctacaacttgggctatttttcaaccaactatgtcctgattattagtgctctaagtatttacacgttgttaaccaactttttgttgttgacggtgattgttttcgtggtctttgggactatgggtattaacaagctaaacggtgcggatttggtcactccatttggttcttttaagacttctcagctttacactggtctactatgtgttgctgtacctttggggttcctagcttctcccatctctactttactatggttgatcggtgcttctatcgtcacagtgttttcccatgcttctttcatggaaaaaccgattgaaacagtgttcgaagaagaaaccgtttaagcagaaagttcatttcgttggcaaacttatgtcactctgcgactcagatgatatcgctccagactaccgtgctctgtaaattttattcacaacagtgatctcatctgccattttataaaatagtataaactcaaatattttctatgtactagtatcttattcatctacaaccttccaggaaaaagaactctttctttgagatcactacaaatggatgttactgttcagttctctgtcaacatcaagcttcacattacctcatctctctattttttgagcccatgctttgggtacttgaccggtaaattccttacttttacaatacgaaaataattcataggtacgtaaatacaaatgtgaatcggttaatacaacaagatatattgtcgacattaggaaagtcacagaaaaatcttcaaggatagcgtacactttcgaatacttacaatgcagaatgacaataaagaagaagtgccggctctggctgttttactaggctcaaacgttaaaaattggccatattctgaggatacattggttcatgccctacaattaaggtctcaacaagaacaaacaaaaagacaatattataaactagagaatgtcaacaagactttagagatgttgaaaactgctgtgagtgctggcattccagtaaatctgatccctcaattattcaatagtgaccattctggtatggaaaccgaccctgcagatttacgtcatatgaatcattctaaggagcaatctcccttattagcggtccctgacaagcagatgaaatcgtataagttccctcctgaaaaccagtctttgaggccgcctacaacaggtgctgaattgaaaactcatcgaagaacacattctcccgctagaataggtgctgaagctgtggcagctcttaacagtagtatggctcttaaagaaaaagaattgcatggtaatgatgatgaaaggcggaaaacgattggttctgaaaggcatatacataagagaatgatgtcaatgcccatcttcaaaaatgaaccaacgactggagtgttaaacttttcggcttggcaaacatataacggtcaaaatctatcagggaatcacccagggtctggaagaaaactcacgacgacgggcccttcatcgtttccacatgcagtaaggaaacatagaagaacacattctacaaactctgcttttggtgtcattgatttgaactccatcaatcaggttgcttttaaacagtcgaattcaagaggtagctctgctattggaaataatgttaatgatcatggggatagtcccacgtcgggaaaaaataattcaaaggtagaaaaagaatctgacccatcctccgttggaacaaatgacgatgctttcggtgatgatagtagcaatgacaccactatcgatgatatcaaaaagatctcaccttctcctcctcgaacattattgaaaggtcctaactatgtggacaatttattaaatacctgattgatactaccggattaaagatggttggaaaattgatctatataagtgcactcattgtactatttcttcttgttctgctaaatattctatttcggagatattcaatgtttcccattcaacctcgccagtctcctcattcattcctgaaatacattcaaattcaatgtctgattttgtgatcgattcaagctctttctttgcttgaagtgctagtgattgaatcacattatcgtttccctgagaaatgaaccatgcgcaaagatcatccaacagaattttattgtaaacgtagtagacatcatggtatcggaatagttcatggatatccaataacgcttttattaccaaacgtttccctccaagtaacagcttgatagccaactgccatgctttgatacagaggtcatagttacgatgcaacggatagctgagagctcttctaatacctgttactatggtacctttgatttgagagaaatgtattaaagactcggatagaagaatctgttggtccaacattgagatctgtggggtcaatttaccgattgtccattggctttcagttgtatgttgtccctcattttcgatctgctcaaaagtgtaagaatataatattgataatatcgttagatattggcttttaacgtcatttattaagtacttctttttaggaatgtggtcttgcatctgagtctgttccgcttcggtgaactccacaggaaaagatacatttctttccttcgattcattgtctgacctttcgaaccactgctgatacctttcgcaaagaggaggaaggtacccaagcaatctttttatgccattaatctggatttcctcttcatcgccctgttttatggttatatattcagcagcatagtactctggatcaaatttcaaattttccttcttcaatctttccttgactctgttctcgggagaagtatgttcaggatcatccaattcgttaatgtcattgccatttgcaacggacataacaatatatcctgtataaagattatcgaaaccgtatttcgttgttggtgtattatctacttgaacctcttgtttgatttcccaatcaaaatgctctccttcttctcgaatatcagcaattgattctttctcattactaatttcttgaatcaacggcccatctgtcactttaggttcattctttgctgccaataatttgctagcgagatctaagtccttgaactctttacctttaactgccttcagaatcttacaattgatgctctcttgtttggaatcatattccactgtatttaaagtttcatcctccaccaattcatctgataatctcaacctcaaataatacggcgacaaatggaagataaacatacaaccatctattacaacctctacaccagcactgttaaaccttatgcttgacaccttaatttgtacataaatgtattcatcatcctgagtgacagtaaatcttggagttatcattaggaacactataccggtaaaatacgaaactccggtaccaagttacttcttgtatagtttctgaaattaatgggtggtcaaattagcaattcagatagttatgtttatagcaactaaaaaggacatataatcccatctcagtggcacataccttgaccttttagaattacagtcatcagaaattacttagacgattacagaaaagaaagaaaaatttccaactttggatatttgaaaagaattaccaacagatgagatgagatgagtcggtttaggttttactgttccagacaccatttaactgcaagtgttgtgctccaattgctaaatagcgccttttgtgatgactatgggtgaagttgagaaaaagcctagaagaaggtttgttggtatcaaaaaagctgcagaagaaagtgatccctcgggatcaaccactgagctagtgaagaaaatcaagcctaagactaacattcgtcatgctattaatcagataccgccggagcttttaaatgacgaagagttaaatgctgctatcaagcttcttccctcgaactataactttgaaatacataaaactgtatggaacattagaaagcacaaagcaaagcgtgttgctattcaaatgcctgaagggttgctcatatactctttggtgataagtgatattttggagcagttctgtcagtgtgagattgtggttatgggcgatgtttcttatggtgcatgctgtattgatgactatacagcaagatcgttggattgtgatttcattgtccattatgcacattcctgcttagttccgatcgatattactactatcaaggtactttacatctttgtcactatcaatattgatgagacacatctaataaagacgttacagaagaacttcccaagaggttcacggattgctgcattcggaacaattcagtttaatccaactatccatagtatgaaggacaaattgttgcagtcggaggaacacatgttatatatcatcccccctcagatcaaaccactttcgaagggtgaagttcttgggtgtacttctgaaagactaaacaaggaacaaatagatgcgatggtttatgttggggatggtaggtttcatttagaatcggccatgattcataaccctgaaattcctgctttcagatatgatccctataatagaagattcaccagagaacgttacgatcagaagcaattggtagaggtaagagcatctgccattgataaagctcgcagttcgaagaaagttggtttgatacttggcgcgttaggtagacaaggtaatctagcaacagttgaaaatctcgaaactaagctcaaggcttccggaaggactgtagtaaagattattctcagcgagattttcccacaaaagcttgcaatgtttgatgatatcgatgcctttgttcaagttgcctgcccaaggttgtccattgattgggggtatgctttcaataaaccattactaacaccgtacgaaactaacgtgatgcttgaaaacgaccggatgttcaatgagaaatattacccgatggattattatcatattaacggatatggtagaggtaaggtcccaaaccatgacgacgtaactatctaagtaaatgcattaattatatcgaattacaatctgggacatcacatttgtttatttaattatttatcttcaacacctagtagggtggaaacttcgttagtcgtaaagtttaatgtcgacattatcatttcttcgtcttccggatatattttgttcaaaacgcttttgaacactttatagaatttgataaaatttccgaaacaggtggacacaatgtcctcttcaaccgctggtggcatcaaattgaataattttacatcttgaaaatcagaaactgctaatggaagataggtgttcaatttttcgtggatattgtcgtgaataactgctaatttcatgattgggttctcaaccgccgaaagatacatgtcgtaatcaagctcatcttgcacagaaataattgggaaaatcatgttgaagagattaaagtacaattccatacccgttgattcgaacagatagctattcattgtttcctttaacttggtaacgcataatgtatactgcgtttccagtttcgaaaagacgcttttgccgtaatcagatgaaaaaatggtgctgtgaaagggacctagttttgatttcacgagatcaaaactattaatctgtacgataagtaaatcaattctggctgacttttcctttttagctgtggggaaccaattctgcaaattcaatactaagttattattaatggggtctaaaatcagcttatcatacaaatcatctgttaatattcttgtttcgttttgctgctccaatttgttcaaaagttgagaaagtttggacaaataatctacaaaccagtctggtggaagtagatcggcagccgcaatttgatttttatccaagtccttgagatatgatgtaacacttgaaacaattttggatcttgcgagattttccagatcattgagactagtcattaattgactggattcattgataccattttttacgagcatcatttggtataaactcaaacactgaacgatgtctagatttagcatcgggttattttcaaatcggacaatttgttctaaccttattctgattgtattcgccaatgaggtaaatatttcgttgagaagcttcaggtgcaagtcaccaatgaaatccatattatctttcaaaactgagtcggacgttactaattctgactttagcttgaaagttgatttcaaaaattctagttcgttaacaatcatggagtgcacgtaagctaggacatcaccaagatatctgacagggtcatgggccgatagtataataggtctttgtaactttttattatctatatcaaattgagacaaaaagtcgtctaataaccttttagaccttaaccccacaattctgttcaagaaatcttgaaagaattgaacgtcatttgataaatgaatcaagctcgtttggaagttagagagagattcatcgccaatagtacgttcgccgtactgccttgataaagtatcatattcttcaatgaagtttatgagataattatatatccgtttgttcgataccgttaaattattattcatcgtttttaatagtgccacgccagcagatgtggtcttctcattggagagtagatatgttgctttttctttgataaagttgattttattcagaatctgaaagaagaggtcattaattgttccattctgtaaatgatccagttctaattgcgttaaagtcaaggaatcccttaatttaattattacctgacgtcttgccttcaattgatcaagtctatctttgacatgttcgaattcaaaatctatggattccgttgtatctttaaaattctgcatagcattgttaattctttccaagggtccagaaagtcttttgattcttcttgcaatagactgaaagttactcaaaatatccgaatgggagttgagcattgaattctcaagctttgagcgaagtgattttctgtttaaagttccaacgaaatcagaggcaaccagttggttgaagttaagtcccaaatcagagtgatttgcatcaaggatttgaagagctcgttttgtttctgaatcagatgtgtaactcgcataattgggaacattcaataagctgttaatcttcttggataaaagttggtttgtagttgtaggtttctcgatgttatttgatataggagctgcgacctccttcgataaagagacggacgcagggcgtatttcaccgagggaaatgctggcaaaatgtttcatcttgctgtgaagatcggtaaactcggtgtcatgcttgctgacattcggtagaacgaatttggcctcttgttcatcgtcattcaatctcaagcttgccaacgaaagacgtgacgctggttgaggtaatgcagcagactcgtccactaccagtgccggaaaatctagaaagtccattacagatatgagatctgctatttataattgagtgcaatgattagttagtatgtcagaatcctgatttcgcgagtagtttaatgtctctttaatacaatttgtatgactttctatttcgaaaaatgaaagatttaggtttttcgtatttattgaatcggtttatatatggtatgtgtgtaattgagtattgtacaattcaaaacataaacaaagtaaagattattattgtttgaatctaccaccagtggagactacgtacctaattaaaataagggacaataagcatctatagtatgaatgaaaaaaagtgaggtattcttcaatatcagaacctggttctaacaaagaatagaataaagtaatttaagttgaaaaggccactgtcacgataaggtcagccttgttgaaaacaatgcgtgcgccgtttttcgttcatgatattcttgatttgaatattatctttttgggtcatctaagtatgagtttcttatatcatcaaacaaatactgtattggcggtaaagtgacatcagaagattttcttctttcttcagcagctggattctgctgaactattccggtccatgattgcgaacgatagtgacgattttgcagatggatttgaggaacaatcgacgggtgtctatattcattccaggaagatctgcgagaaatatttagaagatcttgagcagtattcaagctatctctttcatcgctagtgagagttgagatggaatttgttgactttggagagattgaagcagtgagggacggcgaaatttctgttctttgtgaataccagtattcacatttctcaggaaaatcgggaccaaacaatgggactagtagatatctcaaggggtagcaaaatctcgaacacaactctttagaaacaggatatggcaaccaagtcccttgaatcttgatatatcctcctctaattctcttcaccatacgttcaaagggaatttttgcatcataggattgacccaatagcgttgataatgtagggttcaacttatgccaatgcaaatcgatataagttgagaaggattctctttgaaaccatttgttccatttttgttgggagtcttttttacttggtttgtccagtttaccgtatatgacttggaacaagactttctgcaattctttacaacaatggatgcgggcagattggtcttgttgatattgtctattcgtggtgcataagcatttcatgatatcttggtacaatctccaaataccagtgaaaaacacataccccgtttcacaattccaaattatgcaattgtttggatttatgatcagtgtttggttaatcttggcgttcaatttaatcattctaaattcttgattttttgtaatgttagaacctggtttattggacaggtttatagcagtcctcaactcacggtcagaagaagataaatcatcaggaaaacatggttggtttggatcagtgtcttcttgttcgtcttctaatgaaagaatgttgtatggagttaattgcaaatacggctgaaaatgagggtcaaaagtccgttgtgtcaccgggtttcttgatatatccggaatgatatattcgttacaaattaaactggtagattttttcaactttcccaggctgcccgacttattacgatgattctgtcgcctttcgttggtatattttccattattctcttggcccaaggtatgagatccttcctcatttatatcaccactggattgcgattcgaatgattcaaaaactgtatttgtcttgtattccttccggtcgatagataactgtgacttcaaagcatggggaaattgcgccaaactgggtcgcattagttcatacacttctacaaatagatatctttggtaatcatccaacggatctggagacaactgaaatgtagttccatcggttgggtataccccatattgatcattcccaacaacagatggcatggtgcaattgtctatcgaaagttgattatatcaatcgcacccagggcaagctagaaacaaaatataattaggttgtggtcagaacactaaagaatcgcagaaaccaaaaattaatctgacaaggtcaaattgcagtcagttgtcgtgtctttttttttatatttgatagtcctttattcactgtcaataacactctccagaaatataatagctgtctgaagtggtaatgattttgagatgagacaaaaaaaattcaatatgaaaataaggatccaagacactcaatgtgaaaattagggggatggtcaatattgaatatctgttttccttcagatgccgaatggtatcacgaaataccgacaaaaaaaaggttgcacttcacaactatagggatcggtagaaaatctcgagattgtggaacggctttttcttaaaaaaaaattttcctgcgtatttgcctgaaaaagaatacgtcccgtaattggataggtgcggccttgcggagtatttttctcgtctgtacttcctacgtttgcaatggtttagtcacgaagcgaggatcagtgagttatcgatagcttggtaatgcttctaatatgttaatatgtgcaaccaaagatccgaccgggtgaaatatagtaattattctgcaaacactcagttaccaaaggaaagtagaaataggacgaaggggtcctgaatttatttagaaactgacttctttgctaaatgtacttccagatttttcacaagctccctgtgtctcttcttatggacagtattaatataactatttcctctttcgctaacttggctttctggggcttcctcctgggcactgttgtttggtgcaacaaagggcaaaacgatgggaaaaaaaagctgaaaaaggattcggagaaagtgggggcactaatgtgaactgaccttatgttgatagcaccggttgatcctatgccgagaatgtataactagcgtcgaaatggatgatgacgatgacccagtgaaatcgatttgtgtattgacgggacgtgatcttctttcttctttcttctttagttctttattccgattattatctaaaccctcagatactggctaagtggatagatcgacgtggggcccgatttcgagggccaaaaaccaaaaaaaaaagttgcacgtagtaaaccaagaacaaaggggaaaacactaaggtcaaagtcgtagctgtacgattggcgatttctgatatcggaaatgattatcttatcggcaacggtaaatacaatcagaatcgaaccaaaatatcaagcgttgagaatccagaatgaagtgagaaaaattattgatactactagaacatcaatacctcgtacgcaaataccttaacctaaactctgcgacaaaactagtttccacttttttgtcgaaaagtttcagttgttttatatcgttgaaagatgagtctgatggcaaacactcagcctatgcttttgcttcgtgcccaagaggttgcattattcgacattcccctaaaaaaattttcttttctacgtatatttcctttcccctgtctgttgaaaagcaaatcaaatggctatggtcgacataacgattatataaggttatcggtagttgagcttgtacaaacgtttgttgtagatgtctttctagtcggaatctgacgctctatatgggtgtacaaagaaaacatactagcaataaaatcaatcggcttttcctctcttcgaggtcttctgcttgaatcttattgcttacactttttttggaaaatattctacttcacgctcaggttaaacctgcgcggaatgtccgtaagggccagacctatattgacatattgttggtgagaaccgcaaatgatattgatgcattcaagcctgaaacaaatgcggaggcatcaagcattacaagtaggatatgacaccagaaaacaaaaaaaaaaaattcttggtcttgctgttcgtacctgtgcttttttcttggtatgctcctcgaaatttttttttcttagataatgtgcgccgttttttgttgtggtaatcggcgatcaaaaccgttgttatagggaaacgatttaatacataggaacctagagaccggtttaaatggtttgaaattttctgtgagtgaagcgcctcagctatttctagggaactctgatcgatatacgcatcgacaaagaaaaccgttacagtccacactttaccactggtatgctaagacatcaatgagatcaagtttgtaacttagtgtttgaggtaaacctgtttcactcctacgaaaactgcaactgtaacaagctttggcgttgctgctatttgtttatttaagcatcatactggaatttccaagacagcaatattgtacgggttagcacacttcttacgtactgcttactatgttgactatttgaaaagaagaatgaagtagtaccgtttcgaagattattttttctttgtcactatacaaatgacatgcttgtgccactgagcaatgtgataaagggaacttagtgttccggttctaatgttttctggttttgcaaaagctatgagctttagtttataaaaagaatagaagatattttagaccttaaactagcggtggcgtagagtgtaagtttgaacgttctatatacgtttctatgcgagtatttttttttcctttactacgtaaatatcgcttatgcatttgatgccattttcattcttttccggcttattcaaggctcgaccggccaaataacgaaaaaaaaaaaaaaaaaaagcatcaaatatttatcttgctaatacactggagtaactcagagtctttcttagctccacttgactaggtaagatgaagtatctattcagtgtaattgattatatgactgtttttactgtacctgcctcatttcggcttctaggctaccaaatgtaacgcctttggccgttcggcagaaaatcaagatacaactttgactgggaaatcctgggaaatgagcacttgacaattaattatagttccgttccctaggaaagaagaaaactactgggaaacagaagatatagaagatgcatacatcagtataggcgatggccagctattatccttaaactttgaacattatagtatatgtatttatatgtaagatgtgactgatattgcactttggtgcagaaaattgaaacgataactgcaacttccttgattttgctagtggtttataaatctatcatttccactttaccagaatcaacattgtataacaaaccgtaagtttcaattgatttgttttctagagctttctgtactgtatcgacacttagcaaactttcgtattgtttcttgacgttgagtatcgatagcagacgggactgtttctctagatcattttggtattctggtgagttaagtaaaactttgttctcgtggattaaatcatcaatttcttgcaagtattgatgtagatgggagcattgcaaaccaggcaattcctttctttgatccttcaaacatgtcttgataccaccacagtcagtatgtccgcagatgatgattttgttcacttttaagacgttgatagcaaactcgagtgtcgcaagacatgtcaaatcctccacattgactttgttagctatattcttaaacgtgaaaacctcacctggtagtacgccaacaacgttttcgttgtaacgagaatcagaacatccgataaagagagtgtgagggtcctgcccttgaccatttagagtgaacaagtttggatgttcattttgcatttcagaacgccatttctcgttcgcctttagataatctttaatattggagttggattgtaatgtgaacgggacaaaatcagaagcgacaggtgacatgtttacgtagtgtggtttttcttgtttggtcttatgtgatgactactatcacaaaagtctaagtttcgttaaacatattgcaaacctagacaggatctcattgtccaactcacttcctaatgcttatatataataattccacagttcatttgttagccccgaaccttaaaaaacacttacatcaacagtattcatggttttaggctcatctcagcagaattcagcatcattcccatacttaacgagaaataaagaaacaatttccaatagaaaaaaaggtcaacgaagtgcattacatcaacatttcgtaaaaatccaaaaagaaaaaaatacacaccacatagaaacagtggggagctgagaccgggtgattcatcacgttttattcgaaaccgatagagagtcacggcccgagccatgccttcaagtgtctgtgcgtgggataagagttttgaaaaatgaacaggaacattcaactggaaaagacgtcccgggatgaattgagtcaatataagaacttcggtttatctggtggggatacagagagccctgtagaggagaaacctatctatagccaatgattggtgctacgctggaaaaaaaaaggctcgagataatagtaatcacaaattatcacgctcgaagtccccttccttctgcaattgtctgcaatattcttagtggcgtcagtactgaccgacatcaacagtattttctttttccgtttttccaacatgatggaatagtgataattgttgacgtcaaccttacacagagatggaacgtgagatcagaaaaaaaaagtttgtaggacggtaagtggagagaatatccggtgcgttacccgaatatacgccaggtttagtttgcactaaaagtgggagatgtgaggaatacgtctgtatccggttaatcggaacaatacactcgcataaaaatgattccaagccaacccagctaggaggcgggggatgcggctgttatttcgctgtggctacaggcagtgaaggtcgccacttttcgaagagaagttcttgaagttacagaaaacacatcataaataggcggcaatcatgattatatgagtgttttggcgtgcgtatctttggttgatggaaacgctgagagcataattttgggcgttgtcatatttacgagtaacaccactttcacgtgacttgcgacttgggactagactggttttttttttccagtttttcctttccgcaaaagtcaatactaacctagtgaccaaaagacgggtaacaactctcttttgtcccaataccaataatgtagtatttcatttttaggggagggcatgggattgaaaaaaaaaggattcaagcaagacatctcaacttttgagataacacaaaaacgcgatctaggaactgcggacagaaatttgaagaaaaattatatttacaagttctcggagaagtcacatctgttattgtgtcactcgaaggtgacacaatctagcttattcgatttctgtctggttttttttttcctggctatttaaatttcccatttttttgtgtgatatatctgcaattgttatacttgttgctgtatcaaaagtatcgatattaatgagatcagtaggatagaaacgaaataagttgccaatatagttactgaaacttcaattagagtgtcttgtatcgctactggctcgaagattattatatttctgtgatagatcagacatctaattttgccttttttttgttttgcttgcatcatgaataaccctaatacgatgctaagtaaaagctcaagaaaaccgagaatacctaagcactcacattattttctgtccttcgtttgcatttcttcgttattagcatactatttccttttatcaccatttcaagctgggaatcacaatgcgaatcacagtatagagtgccctttatcaaggtcatctccactaattgaagtgtcagatttcaataggatatctgaattcaaattgcaaccaatcccagtctcgaagaacatttcaaggaatgatttcaataaatggttggaagaacaaacggagatttccttctatcatatgttcgaaaacatttgtcatgcagaaacatcagataaatttgataattgtactcctggtgttgtctttgcgtctccttccaagaacaaaccagattatttctatcattggattagagatggtgccatcaccataaacactttaattaatacgtatcttgatattgatagggaacggactcttgagacagtcttggattacgtgaacgcatctttggatttacaacataaatctaatcccagtgggccagctgatgatcctttgttcagaaatttgggagaaccaaaatatcatgttgataacagcgcttatgaacttgtctggggcagaccacagaatgatggcccaccattaagagctattgcattgttgaacttcttgaaccaggtagacgatggggaaaccgagaaatacaattggatatttgatgaggtaattgccttagatttgaagtttgtgttatataattggcatattccaacgtatgacctatgggaagaagtgcgtgcttatcatttttttactagtatggttcaattgaaggcgctagtagaaggtaagagatatcttttaacgtcggaagcaaaaggtgtaaaattgagcaagcagttgactatactattgaaggatattgagacttgtatagacaaaattgaggattttatcatcgatgccaattcagggtttataaatcatgaaaagggttacattgtggaaacccccagtattttggatgaaaggtcaggtttagacattgctgtgatcatggcaagcaccttgacacatgatgattctataaaagatatgaacaccgtttatgattccttcttgtttgatattgatgatcctttcatattgaatcatttcaatgaactaattgagagaatggcagtactttacccgatcaatcacaacagacttaatacaaacatgggagttgccattgggagatatccagaggatatttatgatggaattgacatctctgaaggtaatccctggtttatctcaacgttaacctctgccgaattgatttacaaattagtcaataaaatgtatcacgatgagaaacctttactcattgatccgatatcgaacaagttctggactaaattcttcgaatttgggaatatgaaggattcgctgatcttgataccatataatacattagcgttcaaccaaacgttgtacacaatattcaaatacggtgattcattcctaagcaaagttaacgagcatgtaagtaacgacggatcgatgagcgaacagttcaacaaatatcatggatacaaccaaggggctccaaatttgacatggtcttacggtactttcagcaatgcacttcgctggagggaaattgtcgatcgattcatccatcctattgccatataagacatggaatcactctttcgaataaaatgtaaaggggcaagttgttaatgaaaagtatataggttgaataaatactttgataatgataaattttagctgctacttgtatctgctttacttaacaaagaaaagtactgaatcctaagttcattgatcgttgcattattgactattaaaacatctataaaaaaacacaagcttaatacgagaatatttacatttattgaccgtctctaaaaagcttttccaacagcagtatggttaaacttgaccgtgttgctattactcaggaacttgtagacctaccttgttagcagtcttttgaactttttcctcttgtgacattttcaatcctggattatatctttcgatcaactgctcgtattcactttgattgacaacaaaggccgcaatatctttcaaatgttgaagagaacgcgggtcatctttcagcgatagaacaatatctttgagatgtttgctatggctgtaaaataatagctctttagatttcaatgggtccttagtcttcaaaatttcaattttttttccaaccgcactgagctgttttaataccttgcttcttgccattgcatctaggcccttctcctgctgttgtctcactaattggatcctattgtatgtcaataaggctatttgtttctttgtatcttgctgtagttgttggattttattgtgcttcgcactacggacaagtgatctcaatagtgacttatatgtcgataacgttagctcactcattgtatgatccttaatatattctatattatcactgctctgtgagataatgataagtggagatatcctataatgcctattataatatgtcaaggcagagtactctcataacatgctagaatcaccaatctaatacagaactcatcgaaacatttttcaacagtcaaatctctctttaactgtcgatccagatcacgtgaaacctttttcacgtttcttctgtaaatctgaagatatatttcattccgggtaatgattcgtgttttttttttgtcacttttctttattttcctcttgttcgttttttgactgactcaatgccgagaacggaacccaggtcacatgatcgcgactgttattatactgcagcgggaccgactttccaacttgaacacaggggaatcaaatgtgacctaaattttgttagaaattggcatgataagtatataaatacaaaatatggaaattgtccagagagatttaaaaaccttgaatcacaaccgctttcattttacatcaacaactgaaaaggaacactgtaaaagatcagtgaagaaagccaattcaattgcctgaacaactagcggatctgccattagtgttataactatcatttctattcgttttctttttttctaaaggttttgtgtttattttaaattcccttctccactaagaaacaatattccagatataatttgaagtgcccttcttttcgaattatattaagcttaaaacaatagtcattatatcagatcaataggttttctcatttccgagttaattgctcttttattttaacttaaaacccctcatattcccggtattacatactaaattacaagaacatagaaaaaaatgttgagacaaggtattgctgctcaaaaaaagtccttcgctaccctagcagctgaacaattgttgccaaagaagtacggtggtcgctacactgtaactttgattccaggtgatggtgttggtaaggaagtgaccgactcagtagtcaagatcttcgaaaacgaaaatattccaatcgactgggaaactatcgacatttctggtctagaaaacactgaaaatgtacaaagagctgtcgaatctttaaagagaaacaaggttggtttgaaaggtatctggcacactccagccgaccaaaccggtcatggctcattgaacgttgctttgagaaagcaactggatattttcgccaatgtcgccttgttcaaatcaattccaggtgtcaagactagattgaataacatcgacatggttatcatcagagaaaacactgaaggtgaatactctggtttagaacacgaatctgttccaggtgtcgttgaatctttgaagatcatgaccagggctaagtcagaaagaattgctagattcgcctttgatttcgccttgaaaaacaacagaaagtcggtctgcgctgttcacaaagctaacatcatgaaattgggtgatggtttgttcagaaacaccgttaatgaaattggtgctaacgaatacccagaactcgatgtcaagaacatcatcgttgacaacgcttccatgcaagctgttgccaagccacatcaattcgatgttttggtgacaccaaacttgtacggttctatcttgggtaacattggttctgctttgatcggtggtcccggtctagtcccaggtgctaacttcggtagagaatacgctgtctttgaaccaggttccagacatgttggtttggacatcaagggtcaaaacgttgctaacccaactgctatgatcttgtcctctactctaatgttgagacatctaggtttgaacgcttacgctgatagaatttccaaagctacatatgatgtcatttctgaaggtaagtcaacaacaagagacatcggtggttcagcctccacttctgagttcaccaacgctgttatcgagaagttagccaagttatgatcacatcaaggaaattatgacatctttttatccacacaaaacaaataaaagaaatttgatccttataatatccttctctacctcctagaaaacatgttttctttaccgtcctgtccctctgaatgaagacagtcacttccaacaaacatatacaatcttcaagatcaaatcaatagatgattatttactaaattccattacgtaactttttaaatcatatatacaatcacgacgacgttcaattcttttgatacagcatcaagtaaaaaacacaatccttaagtttcttccctgaccatagtaaatacaacgattatatatatagcagtttactagtggtggttgatgctcccttccaatgtgtttagtgttcttttggatgtagtgatcgctttcacattgcagcagttctcgagtgaaaaaatcatgtctattgtgagtcaacattagtgaataaatggaactgcttaaatttccctgacacctaactaagtaagctatcagctaatagtgcatatcgaaagaagatggatacaaagtaaatgcttctatttcggaccgaaaaggtaacatcaggccccttccatacatctcatctatgtgcctaatatgtcctggtttttgacatttctcgaattcgagaacaataaaaaacagtacacacaaatacagcaggcttacataatagaaaagactgacagctttgtaaaagttggaatattacagcagccatctctacgatggcatctcgaagaaacagcaagcagtaagaatgagctaatggatacagcaacccagtatcctgctctgccaagttcggattaggcaatgatatgctatgctatgcaatatcatgtcatgtgacgggtgacaatcgaactattttctttaccaagaaaaccactttttccaggaaatgcgctttagtggttctatccgaagacaaaatgttgccatcctgtagcctgaatgacactgatacatagcagggcatatattaatcttgattctcctctgagacaaacagtatatttataatcatctgtatcttagtgtcacagcgtgccacacagacataagttacgtattattgcgatgtaggaaataaaatggaaaatgagatttttccattagaaccgatctaacgtccattttgattgggtattattctgagcttcattctccgaacgatcaaccggtgacccaccggtgggtcactggtaggtaaagttgctagaggagatattctttgtctgacttcgggttttgaaccttctatttaggttgagagtcttagtatgtcccaaaaaaggggaatgtctgaatgtattgaaataaagaaatgaaaataaagaaatgccactttttcatgcacacataaatcacagcagtaggaaaactaatagagaatgattatggagcccatccaaaaactattgacgtattgtacaggtttctgaaaagttttcaaactgcactcagtgttgacttattccctacttgttctggggcattttgctttggtccttttcatgagatccacactcaaacttaggtagtaagtgatgtaagtaggtagcttacgttattgtttcccacagtatgtcgccttggccataagaaagctaatggattggtaatggaaacaatgataatatataaagagcatacaattgtacatcagactcaaccatgtgtgcaagtttacatttctgaccattaactattagtagcgttaatgaccagtaaagggataatcgtgaaaacacagctcatattcaccccggtatataatagttgacattgttaccaagttcgtttcatacttatatgcaataaaactatcctgtctgaacttatcttttccatctcagatctgccatacatataagctgggactttccaggatctaataagagcccgttcaaacactacttattacagtgttagggtgaaggacataatcaatttttttccggtaaaaatgacgtcttttgagaacagacttcagggttcagacaacgggtcagtttctgacgattacgatgtgcataagacgctactcaaagcacctggccaaaaacaccaagatgtggaagacgtagttgaagtccaaaactacggtgacgatactagcgtgtcttacaaggatggcctcacagaaagtgacgaagaagggcatcagattaaatacaagacttgttcatggcagcatactacaggattattgctatcagaatacatcgtcctagccatcatgtcatttccatggtcttattcggtgttgggtttaattccgggacttatattgactgcatttgttgcaattaccgtcttgtacacaggacttattgttttggattattgtgaacggttccctcatcttaaaaatgtgtgtgacattggacaacatctattctggggcagcaaggctgcctggtatgcaactgctgtttgcttcatagctaacaacacacttatccaagggttgcacgtcttggtcggcgccaaatacctcaataccgtcacaaatcattctgtttgttctgttggattcgcagctattgttgctgtcatttcatttgtgttttcaatcccaagaacattctcctccttatctaaagttgcatacttctcagctattaccatgttcatttcagttatcttggctatgatctttgctggaattcaggatcacccagctggctatgatggtactgctgtaacgtatcaattatggcctaagaagggaacaacatatgttgatgccatgggtgcatttttgaatattgtctacacttttgttggtcaaattacttatccacagttcatctctgagatgaaaagaccaagggaattcaagaaggtactttggatagtcactgcgctggaacttattattttctccttagcgggggctttgatctacgtgtatgtcggtaacgaatacatgactgcgccagcatatggatctttgacaaagacttacaagatcatttccttctcttttgccatccctaccatcgtgttcgttgggtccttatattctaacatctcatcgagattcgtgttcttcaatgtcttcagaaactcggagcatttatactctcataccaaggtcggatggttggcttggattggcttattgttattgacttgggtaggtgcctttgtgattgcagaggttattcctttcttctcagatctattgtccttgatgtgttctttattcgattgttggttcggatatgtattctggggtatggcatacctaaaggtaaaacaaaataaatacaagcagagtaacccttatccgtacttgactaagattgaaaaggttcatttcatcatagcgggaattctcattactatcggaatttatattttgggacctggtctatacgctactgttcaaagtatcatttacaatttccaatcagatgcatatggctcagtcttcagctgtgcttccaatggtatttaaaagaaaaaaaaattgtaacaattttcccttgtataagtagttttggataacttttaaccattccttgtaattcattcaaagttcacacacaactcatcgttaattctagcatactcgcgttgtgacctttacctgaaggaatgtaagttactaaaaaataaaaatatataaaaaatcactccgcgacggggaattgaaccccgatctcgcacgcgacaagcgcgaattctaaccattaaactatcgcggacaactttctacttttagagcagataagtctacctgactccaactatgggtacataactctgccccctcctgccctttaatttttcttctagatcgaccatctgcttgttgactcaaaactcgacactactattcacggcttctatgttttaacaaggcaacgaatacgagtcaatcacgttaccagatctcgcatactacataatgttcacaaacagaataataatgaatgctacagttataactgctgcggatcatgccccttatttctgaaaggaatcatcactctactagcagatatgaagttcaccaagtatttttttttctgtagatattctgaaactgatctggttcgagaaacacggggttttattgctgtctatagtgatgagaatgagaaggggctagtgtgcattcccgcaactgaactcccaaagacagttatacatctctcccacattctactgtattttgactcttttcgtgttctcattcactggtccctgtgaacacttaaaataaaaaaaaagtgataaattaatacatggcagtgggcacgtggcacgtgctgaagaaaccaattcaaaactgaagaaatgactgtaggaggaaaagaaaatagatggataataatttatatttcacaggaaacacgtgtgactgcagcaacggtggtacggctttcgtcatgacgttccttcaaatcgggcaggaccctaaagggctgagccatgattatcggaactgactgcatcgtttttgtagcgtctggttagcaagcaaatggcacagtttgcacagtttccatgtgttttttcttctagttaagaaaagatccttcatagtgcagtagaccctgagaacccttaggtttttgctgcctttgtttctgcgtttccgttgtgttttcaacattcaagagaatcaaaaggtagtaatttcttttgttttctgacatcgatgagttagatacgaaagactgtctatactcctaccatattggacaacctctttcactatcgtttctacgaggtggagacattgcactgtagttactgtgcgaaagagtaagagttttggtgatcaatggaatgttttgagtattggaatactacctgtgttctgtagcattaggttgttaattttaatacatggaaggatgggaaagttgggatggattgatgcccacgtttattttatgattattactgtctgcatgggagaaagtagtgctgaaaagttgttaatttaattcgtaaggaccccaccagggttcttttttttcctttcattttttttagttataaaaggcaagcgaacattgcaccagggagcaagtgtactcatcagcagcatctatttaacttccattttgaagctagctaccaaagaaagcaacagaacaagcataaattagtcaaaccatctgtcctataggcgttttttccttttcttttctaatatttgaaaatacgtgcaaattaaacgctgatcaaaattcagatctaataacacatcagtgcaaacaaactaaacaaaaatggctttgcaacagtttgattacatttttgccattacaatgctctttgcattcttggatgcatacaatattggtgccaatgatgttgccaactcgtttgcttcctctatttcatctagatccttgaaatactggcaggctatgatccttgctgctttatgtgaatttttgggggctgtcttagcgggtgctagagtctctggtaccatcaagaacaatattatttctgcttcacctttcgaagatgatccagctgtgttaatgttaactatggcatgtgctcttgtcggttctgccacttggctttcaattgcgacatctattggtatgccagtgtcatcgactcattctatcgttggtggtaccatcggtgccggtattgctgccggtggtgccaagggtgtccaatggggttggggtggtgtttctcaaattattgcttcttggtttattgctccaatcttagccggttgcttggtcactattattttcttgatctccaagttcctggtcttggatgttaagccaattgaaaaagctattaagaacgctttactactcgtcggatttttggtgttcgctaccttctcggtgttgactatgttgatcgtttggaagggttctccaaacttgaagttggataaattgtctggcacaactaccgcattggctattgttcttactggtctagtcgcttgtgctgtttacttcatcttcttgtacccatactacagaagaagaatcttgcacagagactggaccctaaaatggtatgatatttacagaggcccaactttctacttcaagtccactgacgacattccacctctacctgctggacaatctttaaccattgattactacgaaggtagaagattcgaagatgaaactgccggagatgatgaaacccaaattgaaacttcccacaccgccgatggaagagatactgtagagggacatattgaaattaacgacaaggaatctgtcaaccaaagtatcaaattggtgcaaacagaaactttgcaagaagaaaaaccaactaccaaacagctatggtggtcattgctaaaacaaggaccaaagaagtggcctctattactttggttgattgcttctcacggttggactcaagatgttattcattctcaggtctacgatacaggtgctttgtcaacagatttcaaggacatgtacaagagatctgccttctatgacaacagaatcgaattcatctattctatcttgcaagctattaccgccgccactatgtcttttgctcacggtgccaatgatgttgccaacgccactgcaccactagctgccgtgtatgacatctggcagaaaaacactgtggaatctaagtctgacgttcacacatgggttttagcatactgtgccgctgcattggtcctcggttgttggacatacggttacagaatcatcaagaacttgggtaacaagatgattttgcaatctccatccagagggttctccgttgaacttggtgctgctgttaccactgttatggcaacacaattaagtattcctgtttctactactcaagttgctgtcggtggtattgtggccgttggtctttgtaacagggatttgaaatccgttaactggagaatggtcgctttctgttacagtggttggttcttaactcttccaatggctggtctcattgcaggtatcttgaacggtatcatcttgaacgcaccacgttacggtggagattaccaattatcataatcatcagattgatattttctttctcatggcctcagcgccttttaggaactttcattaattaattgtttgtgcactagctagataatagtttatctgctacaaatatagaacatattcggtattatagattctgcaaatttcctcatatattagcctgcatatttaattctttctaagcagaatcgatatttatttctatcaacgcttattctctattgttttaagaatctgtagaatatctttaaaaacaaaacctttaaaatttgtatcgaaaggacatctcatacagtaaactattcactagtaaatcatctgagtaaacaactatcacggtgataggcatggagactcccagtttcctaaaacaatctccaccacctggttacatcgctggtataggtcgtggagcggttggcttttccaccagaggaagtaaagatgataaaagagttcctgctagattgaatagatatgggcgagatgcaccagatacttctgtaacaaagaatccaaatagatacagatcagcagtttcgaatgaatcatcggagaaacaggttaaagatgaagacgaacaagagatgagagtgtacgaaaagatcgaacagcgacttaagaataaaaaaattatcgacaatgaaacaagcctaaagacgaagccagatgatgaaccagacaagctatcttctaaatttgtagatttgaagcgtaatttagcaactctttctgagcaagactggctggatatccctgacgcatctgatatgaccagacgaaacaaaaggaatcgaatagaggaacaacttgaaaggaaaacattcgctgctcctgacactttgttccaggttaatgtcaacttatccaagttaactgaagagagggaaaagttacttgctgtccagatagataagagttttgattacagcaaaagtcaacttacggatgatgctgaatacttgaatagaatgaaccaagatgacaacactatttcatctacggatttggaagacattaggaaaaacagatccctattagccgcgtatcgtaaatcccatccaagaaatccagaaaactggatttcttcagcaagaatcgaagaaagagccaatcagttcaatcgagccaaaagtttgctagcggaaggttgtaaactgtgccctaaaagtgaagctatctggttagaatcgatacgcatgaacgcatccgataaagaatattgcaagaggttggttacagttgccttaaggctcaacgagtttagtgagcagttgtggttgaaggcaatcgccctcgaacaacacaatactgataaaattaaagtcactcgaaaggctctaattaaactaccactaagctctatattatgggaagtggcggtaaatcttgaaacttccactcttgaaaagctgaaaattttgaagaaagcagttgaattagtgccgaaggattcgcagttatggttgaagttgataaggttacaatcagtcgaatctgcagtggacaccttgaaatctgctgaagaacatattaaaaaagacatcacatactggcttctcaaatgtcaactcgaagaaaaaagaacgaccgcaaatctcgatacgttggtaaatatcatttctagcgcaataaaggatcttcatgaactggaagttaatccaactattactgagtggttcgaaaatgcagtcgctatatcaacagaaggattgtatccattaacagcgaaagcaatcatcacagctaccatcaataacttatttgaagacgcatcctcaaatttccaaagtctctcgaagctgttggtaaacgacaccacacttcagtgtaccttgttttcctccttcctaatcaaatatccaacaaagtactctatttggaaggagttcaccaatttcgccgaagacttttcgcggaaattagagctacacgaaacattcaggaagatcctctttacagattctcaagcggtaaagaaataccctgtcttggttttaatgtatgcgaaagacgtttgggattggggttctggttccactgaagcgttgtcgattttagataaagctctggtgacaaattcggcgtatcctgagttttggttggctaaactcaaaattttgaacagagatggcaaattggatgagattataaattcctttgaagaagccgaatcacacttggtagaatgcattgataaattagttcctttttacgttaagtgtttgcaatctaaaggcagtttggaaatagctcattctactgttgatatagctttggcacgtgaaccaaacgacaaacatttactaatcttgaaagcacagctatacaggcaacaaagggacctttcatcagcgaagcgtgtgctacagagggctacggatatttctaatcatgatccagaagtgtgcttggagttctccagactggtaatggaaacacaagattggggcaaagcgcgttcaatactcagcgtttctctactaaagaatccaaaatccgatacactctacgaggctctcattacattggaactgcaagtgaaagataacaaacaagtaacgtacctcatcgctcagggtctcaaagcgtgtccacacagctggaggctctggtgtctaaacatcagaacccttcctaaaaaatcactacgtaaaaccacattccaagatgctctcgaagctacaaaagagcatccaatggtgataactgagatcggaaaagtgttccaaaaggaacaccaatacgcgaaggcatataaatggttcataagagcctcggaaaataatcttcaatttggggacccatgggtatggctctacatctgcgagtcgtgcatgaatccagttgatttgcaaataaatgaagaaaaaacgttaaagaaattgaaagaaaatgaacccaggtacggtatactatgggagcccgcagtaaactcatacctacacatatcaaactctccgattgatattttgcacagcattatcaacaatttacaccaataattagatagaatgtaagattgtaagattgtaataataaaaattgggacaacactgatgcgactgtaaattgactttccgcattgtcagaagttccgttcctcaatcgtaactaacccagtatatgcggcagttctgtgtatttttccgttgtgatctgattctctgctatgaaagagtcagctcttatatctatcaaagagaactttttccagtggaatttgaaaatttgaaaacgaacaaccaaaatggaacttcgaaattgcgaagagtattggtagtcgacagggatcggaggtgaagtgaaaaacatcgatagcagctgttgagagtcttaaatacccgccgaggtccacgtcatttttaccagggaagttatatatatatactgataggtcagaaaaagtatgtcgttcggcaagggacgcaatgagagtttggattgtctcactccagcatcgtatgtgtctcaaggtgcggcacctgaggcaccagcaccgacccaaagtgtcagggcaagccagccgccactattcccagctagtagcagacatattctgtctccttcgacgttactagcgcatccaagtccgcattcagtgcccagtactgctactctgcttggactttcctctgaacacgtaatcactagtcctcagtcggttcagttgaaaaatacacctacttctatcggaccaagtccaagagatgtgctagttaccaatctatcgccgatctctgatattttacaaggtgatcgttcatctatgtcacctgcatctggaatctcttccgtagatgcatcgggtgcaacaccctcgacagatgcagatgggaaaatcgtcaagcgtaagtattctagaaatggttgtttggagtgtaagaaaagacggatgaaatgtgacgagggcaaaccgacctgttggcaatgtgccaggttgaatagaaagtgtgtgtatatattgaatccaaagaataagaaacggaaacccagaaaacccaagtctgcaggggcatgcgctacatgtactgaagatggtgatgagaagggaaaggttaagaatgatgcaacgatgaagagtgaaacaaatttctcactgaatagccatgttaatgattctttggtaaattcaggattgccaaacctcatacctgcaggtagcattaacgctatggatgccaatcttttgattcagaatctcaacgacattgttagtatgaagttgaatgactctttggttagcgatgaattaaaggatcttgagtttaacgacttagatctgccagatctgaactttccaatgcttaacactgcttcggagttttcatcagttccaatctcctttttggtcgataatacaatcactttcaacacatctctagaatcattcaagctaggtggtctgcatgataaatatctgcgaaccttttaccatgactgtttggattccatcacacctttctttcaagaccaaaataatccacttagagatatattactgtcattcggcaggaacgaaccatatcttctctcggcgattttagctgtgggcgcctctattgttcatcgtaaatcaaacaaaatggaggatgaaaaggcgtattgcggctatttatcacattgtttgcaactcctcggagatcagtttaaaaatgaaaccaacgtcattaataagcttgagcctattatcctaactgtcattttattaacttgggattgtatctatacaatgaactcccaatggaggtcccatttgaaaggtatcactgaacttttcaagaagatcaattcaggaaactcatcaaaagtgctaaatgtcgcgaaatgttggtttaaggttatggagacttttgcaagtattagtaccgtgctaggtggtgcacttgttgaggaaacagacttggacgcgatttttgatccatacgatttccagtatgtcgagtcgttgaagtctctaaatatcacaacctcgttgaatgagttcaatcttttacggggtcacaacgaagagtttgatcttgttatcaaagaggtcttcaaaagtttgaacttgattaggtctttggagaagacaagcatggacgggaataaaggtggaatgatcaataaaaacatagactatttactcttctttgactctcactctgaagcctatatgaacaagctctcttatttcaagatacagaaaatcatcgtggaaattgataagcagcttgaatatcaattcattgacaaatccggtgtaatacctgcagataatcaatcacatccttctaacagcaaaatactagatcatgcaatagatcttgttactctaaaaaatggagatgtcattgcgataagctggtatgatatttctcatcaaactcaagttctatctttcttattgattgttttactaaaactacttggtattccaaaagagtccattgctgtacagcaagttgttaagcgtatcatgtccttattccgatttttggatagtgatcaaccaccagttaatctaaggacctgttattctaactttgcagtgcttattgccgggctaaatgcgatcgaggaagaaacaaagtatttggtacgaaaatactacgaagttaacggatcaaggtttagaagattgacggaacacaacttgaacagattagaaaaggtatggagcggtaatgcaggaaagttcaatcttgaggatcaagacgttttgacatggtaattccataaccaaacttttgttatatttttttaacgttgtactaatatagcatataattttataaagacaatcgtattatagaaggtgaacgatattcatattaaaggtaatttgaaattcagaagtagataaataatgcataatttaagctgcccaaattttcaatatccatcagatatcaaacctacctgaaattgttcaccagttgtccagtttaattttcgaccgaatccacggtcattaatcccaaaatagagtctactacttgggcagcaataattgttgtaatatcgccgttcgtatcaaaagcaggaagcacttcgacaatatcggcaccaataatattgagtccttccaatccgtcaaggattgtgagcaattcccttgaagttaacccaccggtttctggtgtaccagttcctggagcagaagctaaatcaaccacatcaatatcaacagaaatatacactggtccatcccctacacgtttttttatggcagacaccacctctttcaagctgattatgtccaaatctctggcgacaatcttttcgaatccacattcgtaatcatgatcttcatcatagaatccaggtgcaatgtaaggggctctaatcccaacatgaatatttttatcatcttggagatagccattttcatgagcgaagtgcaggaatgttccgtggttaagaccagcacgcttggatatattacctcctaaaacttttggatcccaagtatccaaatgagaatcaaaatggatgacagaaaccttgccgtaatgttcataagcagaacgcagagccataagtgtaatcgtatggtccccacccaaggtgattaattttggtggctgctctttatgaactaatgatgagtggttgtgcaacgctctttgtcccctgtacaattgattaagagctagtttgttgtcaaatggagtcattgggatatccccacagtcaacgatcttatatccagagtggtaaggatctagtttacgtaacttcgatcccgggaaacctctaacaggagaaataccgtttcctaatcttctggagccttgtcttattccgttagggccaaatctagcgcctggtctataagacacgctggtatcaaatggggcaccaacaatagcgatatccatctccaacgaagtgtttctgaaacattgggcaataggggtgtgtgcaaaggaaacaataccagtgaactgaagtaaatcgtcctcaaaatcgtcttctggatattcattctcgtgatcgttgtagaacgaacacattcccctaaattcctcatccgtctcttctggatgaactttgatcaaaggccgggcagcagcaacttcactttcttctccattacgagactgtaacaaatctccatatagctgatacataagtgagtcctgttgcaacaattctacgtcaactggtgcatcgttttctatttggaatgaagatgacttttgattagttgcaggaacgaaatgcgaatgggcaattagcaagtaactaaatagcgcagtaatatacgctatattattagcgatcatgattaagacactgaaggatagggttcagttgattaacagttaaatatttgcttttcattcatgcaatagctatgctgccttttttctgtaaagctattcgagacgaatttttccttgtatttatgtaccgtcgaatttttttttttttaaagagtcatgctaggttcgaaatcactgggatatgcaggcataatctcaagttgctatctttcgggaaatatttcctaaattggtataagattgcatgggatatgtgaaagaatgtttcccataaacaataagcgtgcttgacggaaggaattaggtgacgacgggtcgtatatactttgagagaactaaatgaaatagattttaattggagatagtttagataagagataaaacaggcttgaatggggtagtaattccatggtttcaaatactgttgtcagcacaactgaagaccgtaccataagcattcgcctggaaattgtaaatgatactttgaacggtagcgtataggcctggtcccagaacgtagactccgaaaagtataaggaatcccgctatgtagaaacgaattttttctcctttatccaaacatggataaggattagtcttttcatatttagtttgctttacccttaggtatgccataccccagaatacaaatccgaaccagcaggcgaacaaggaacacatcaaagataatagatctgagaagaaaggaatcacttctgcaacaataaaggcaactatccaagttaacacgattattccgatccaacttaaccacccgatagtggtatgagagtgcatgtgttctgaatttttgaagaccttgaagaaaatgaatctggttgttatgttagaatagagagaccccacgaaaatgatggtaggcactgcaaaagagtatgctataatcttgtattttctcgttaaggacccatatgcaggggtggtcatgtattcattaccgatataatagtacattacagcacctgttattgaatagatgacaacttcgattgcagtgacaagcaagaacaccttcttgaaatccctcggtcttttcatttctgagatgaactgtggataagtgacttgagcagcgaaaacgtacacaatgttcaaaaatgcacccattgcatctacataacttgtgcccttctgtggccataaactgaatgtcaaatgagtaccatcataaccaaccgggtgatcctggattcctacaaagatgatagccagtattaccgaaatgaacatggtaatagctgagaagtatgcaactttagacatagaggcgaaggttcttgggatagaaaacacaaaagaaatgattgcggtaatgacaccaaatgcaacagtacaggtagagtgatttgtgatggtattaaggtacttaccaccgactaagacatgcacaccctggataagggtattgttggcaacgtaacaaacagcagttgcataccatgcaaaattacttccccaaaataaatgctgtccgatgtcacacgcatttttaagatgagggaacttttcgcagtagtctaaaatgataaaactggtgtataacacaacaccagcaacaaacaccgttaaaataagacccggtattaaacctaatactgaataggaccatgggaaagacatcatggctaagatgatgtattctgataacattagacctgtaatatgctgccatgaactagtcttgtatttaatctgatgaccttcttcatcgctttcttcaaaagcatcacggtaagataggctagtatcatcaccgtactgttcaaattcaccatcttccacatcgtgattcttgacgctgggtgtcttgatcatcgtcttatccacctcataattgtaaaaggtcttcccactctcagagccctcaggcttacttccaaatgaactcatctcgatcattataatagcttgattgccgtaactttctgtcacttataggtgaaagaggggagatattggaagatagacggtagattggccttaaagagaagaaatgtaggtattcttacttgattttttctagcgattcttactccgattgtggttgatttgagtcttgaaccggatgttatcaagtcttgacaagtaaggttgagctgaatatggattgttagtgttaatgttttccggtattatattatacatttattagcagctcgagatgaaggaaacatgcatgaagctcatcgaccaagtgattagcttgcctattttatatgaaatatcgttttccttcaatcctttatctcccatgcattcctaaagagagataaagtggagagattaacgttaagcacctgcttgctatctagtttggagtaacagttcatgatgtgtattaaagccaggatctgctatcaacagcgacctcaagttttaagtttttagatttcatcacaaagcaaaatgatacctaatatggaaatattttgcgtgaatgtgagaattgtattccgaaccattttagacttttttatacctcgacgatctgcatgatcagtggaatttctctgtttatctgcacgataagaagaatagctattctgttttgtcggcgcattagtgcctgatttcgataccccattcgggccactttgtgtggatgttctttactcagtgaagtgccatatcaagtcatttccctttatggtgatgaaaaaaaaaaggattggtacgtaaatttgatgtctgctcttgatgtttggttttatttaaaggaaggatgaagaagtaatcacattgttatcttttaccgttagccagtagttctgtaacggcgtctttcatcgatatttcatcgctggtcgctgttctagagaaacgatgaagcaatagtgtaatatcggtattactcttatatttaatacgttcttcaaattgtgatagaaagtatcaggattgcctgccaagaaagcttctagagatacaaatagagtctttaaatatttatgaatggtaccaggtgaagactcttcattaattgcccatagaggaggcgatagcggatacaatacagtggaatccttgaaaaaggatggggaaacgagcttagagtatgagttctggtatatgactaagacctccatcccattaatcattacgtttctcttgcaatgttcattatcgtcctcagctttggttttcgctggaagggttgggactttagaagttggagggatttcgatcggaaatgtcactttcgcggtcacttcggctatatttatcggtattgcaacatgtttggatacggtttgtcctcaagcgtatggtgcaggtaagtacaacatggtgggactgtatttccaaagaggtgttgccatttctttcctatttgccgttccggtaattgcattttggtataattcagagtacgttttatcgtttctagtggaggacgctgacgttgtccatatcgccgctgtttatttgcgtatcatgattcttagtcttcccggctatatcatattcgaatgtggtaagaagtacttacaagctcagggagatttcgtaactggacaaaacattctgtttgtctgtgcaccattgaacatattgttgaattatttatttgttctaaagtacaaatttggctacatcggatctccaatttctatggtgctgtcttatactcttatggggctcacaattgttgcatacatctgtcgtcaaatatattttggtaattcttcctgctggcatccgataactgggaatttctcggcaattttcaagaattggggtccccttattgctttagcgctaccaggtttgatcatgatcgaagctgagttttttgctttcgagatcatcactgttttaagcgcgaaattcggaacggaagtcttagctgcacaaagtattgtagcgaccttacaaacgtttttcttccaattacccttcagctgcagtgtggctgcttccaatagaattgcctatcacattggttctggaatcacggaaaactgcaagacagcgacgaaagcaactatgtttggggttggtcctgctgcaggaataataaatttcacagtgttgtacttcggtcgttacaagttatgttctttgtttaatgcggacccggttttggtaaataaagctgcaggattactctgtgtcgtcgcattaaatcaaatatatgattgcttcaatgtcatggctgcaggtgtcttgagagctcagggaagacaacgaatcggtgggtatttaaacataatggcgtactatctagttgggcttgaagtcggtattttattagcgttcaaattcaaaatggaagtgctcgggttctggataggtatcggggtaggtgtcctcttcctagctattggcgagaactatttcgtttacatatcaaactggagaaatattattagcaaatcgcaagacctacgccatgaagcgtgatcattgacagattatactgttttttaaatacagatcaaaaaaaatcagagaaaatattctagttcactagcaattatttaactgggccttgtatttacatatataggtaaggatacgttcttcttaagaaacttcttcgtgttgattatcatattaggccggaactaattattgcctgtttttccgtttttccgttttttccgattccttcgttgttttccttcagccagaaactccaacaaagatgcaaacatcttctcaaaataagggtatatataagtggtaaaagaatcatgcaattgaataagaataagaattcgctaatgaaagaaattgatcggatataattagagtttgaccattcggaagagagtgtttttcaaattgattgtattctcttctcagtgtgagcgagaaccatagtcgaaaagtgcattgagcctgtcaagaaaaattataaagaaagcaatgaccgaagtaacggaaactgttcataagaatggaccatactatttcgatagtaagatcagactatcagagggtatcagctatgcagctgaatccaaggcgctcttctggattgatatctacaatgcctacatccatagagtgactgatattgacgatatttcaactcatactgtatggcatgcatcagttgataactatgagggcttgtacccatttactactgatctaccagaacgtattggagctattttcccaattgatagagcagatggtgttgaagaggtttatttcggtgctaaatatgggattgccagaatgaattacaccactttgagatggcaatacttggttcactatagtgacagcggattgcagaaggattggacaggtttacgatccaacgatgggaacgtctctccagatggagaaatattcatcggtattatgaacgatttccattgtactgttgattcagaggacccaaagggcgcactactaaaagtgaacctccgtgaaaacatatgtgagttggtaatagataaattgatgattcccaatgcaatcaattggagccaggatggtacaacggtatatttcactgattctctaaacttctcgatttacaagtatccgtaccaagacaaaaatctcatcgtggaggacaaggcattattcattgatattaagaagttcaattcccaattcgattcacctgaacctgacggcagtttcatcgatcccgatacgcacaatatcatcacagcggtatggtctacgagtacggtgcaaaggtacgataccaaaggagatctaatccacaaatggacgttcccagagaccaatcgaatctctgcatgtaccttggcccaaggtcacatgtttgttaccacagcaaacgaaatcattgaagataacgcaagtccagagggccttggtggatccatctttaaagtagagaatgtctcgacttatatggggtcctcaaagaggaacccgattacggcagagcattagaagcccttatgatgcacgtgacatgtaaggagtttgcgttttcaatcccgtgatccccagtttttcaatttatcatattttactaagtattaacaaactactgacaaagcactgacaaagaatttataaacatagaataacttatgaatgtttatggtttatacgacagcgaaacaactatcaacttacatagtgtttgtaacgtcttaattaaggtgccttaattggctgacttttcattatgacaaattatattcgcatatttgagatttataaaatttactaatctatagcgtacttttgccgtaatactatatcttcctctgaagaaattgagaacagggtgatcagaattgctcatatagattattaagtttaagtaaggcttattggccctacttactatgtctattattaattttaggttattgatttgtacacctacacctttttctgggccccttcgaacctttttttttttacagtcttcccctttcttacatggattgaaactttcagtttcaggcactatataaatataactaaggtaaaaaaggaaattaaggaagccttctgcagttaaagggttcaattataataagtttagtagctacaattctttccatctctttcctgaaaacctcgagaattactcattcactcaccctaatataactcggaattatctaacaaaaatggctaaggttgctattatcatttattctatgtacggccatgttgctaagactgccgaatacgaaaagaagggtatcgaagctgccggtggttcagctgacatctatcaagtaccagaaactttatccgaagaagtcttgaagttgatgcatgctccagccaaaccagactatccaattgcttctaaggacactttgacggaatatgatgcttacttgttcggtgttccaactagatttggtaacttcccagctcaatggaaggctttctgggataccactggtggtttgtgggccagcggtgccttgcacggtaaggttgccggtttctttgtttctaccggtactggtggtggtaacgaaatgactattgtcaacgctttgtccactttagcccaccacggtatcatttacgtcccattgggttacaaaaacgttttcggtgaattgacaaacttagacgaagctcatggtggttctccatggggtgctggtaccattgccggtgcagatggttccagaacaccatctgacttggaattgaaggttcacgaaatccaaggtaagactttctacgaaactatccaaaagttttagaatacaaaatactctctctatatgatacataacagtaagatttggcagatccagcatgtgctttgcaccgtgccagagtactagaaaaaaaatatcaatccgaagttttctggcaggtcttctggcaagcttttcggcttatataacatgtatcctactgacattcacggtaactggtactgtcaaatttaataaaaagagagtagatgcccgctccgatcatgcaagatgactatataatgtgtctcgacatatgacaagaatcgatgacaccactattgactgaatcagtgtatggtatagatcaaggtagaactcatgtaaaatccagaactgaccaaagtgacaaaaatgaacaaaaaaaaaaaaaaatttgtcctgctaaacaacggataatcccttgaaatttagttggcccctgggccaactgaaatgttccagttcccgtttcatcttcgacaaactcaaaacgctccgctaccgtgcgattttcttttctcgctatacatgtataacttgggaagttagaatttccaaaaattgaaatgaataattaacttggaaaccagctccattaaaaaaagctaggagttgtatttcctcagtaaattaataaattcaaacacaacagaatatagcgtccgccatactaggatcggtttatactctattaccctgtaactttacttacatgtctaaacacggtctgttgtaagacgtaagcaccaaagcgtcatagacaaattttgcctccttttcgatcttttctattgaacaatactggcaagcggtactcattattctgttttcgtttttctttttgggaatttagtttggtttccttttcttttggactttggtttgagctttcaaatccactttttaaaaagaacaaagaacatatagaacatatagaacatatagaatgtaaaggtttgggggaataggaagaagagcaggtttaagtgtgtattctgattgcctcgttcgacgatttttgttttgtgctaagcattttcagtgatagttacaatctgctttaacagagagagagtcctttatttttcctgaagcgatttgtggtataaaggagagttaaacgatagtgtgatttttctatttggtctactttcattaggcaaaatcagatttctcactatactactgttggactgaaggatagcgtctgataacgcttgataccctaggcttctttcgttgtctggttctcagttttattttattttattattccattaatttttttggatcgcaggaatcaccttctaccatccaagcagagcttacttgatataattcaacctagcttttttactgcgtgatacacacgcggttgaacaagacagcagagtataatattcagaaggttttaccagataaacacagcacgctttgcattatgcagaataatttagcggcgtattttgctcaggggaatgcttctcaggggaatgctaccccgggtagagtcgcattgaacagaagctcatcgaatgatgaatacggaacaagcagtgtaaataaacaagtcccaaattacgacgatatgggtccttctgtgtctatggcggttcatgctgatgacgacgaccatttcaagaattctacgttcaatttgaaaagaacacgatccatgggactgttggatccatacatcgacgatactcagaaacttctggcaggttcgagctctgttgattccgataacttctctaacagtaacatcgatggcttgagtaacgacctcaatagtggtgacagtagcgggagcatgaataatattaacaacaacaacaacaacaacaacaacaacaacaacaacaacaacaacgacaacgaaaacaaaactgataatatcaataaaaacagtaataatacttcttataatgacgataacgacggtaatgatactacgcttaatgacaccgggctgaataaacacaatacaactgttggcggaaccgacgaagactacacagacgaaaacatgcaagtcgataactacgacgatgactacgaagcagattacgattacgactacgactacaaagatgtagaagattctaattctcctccagacccgggtactgacgatttcctaattcatcatgatgacaacgacttgatgtatgaacccaatagacatgtggattacttatctcataaatggaacgaaaacgaaatatctcagtcatggcgttatatcattttgaaaaagaaacggaaggacacagatttaatcaatgctgcaaggttggaaaatgcttcctggagaacttggtcaaaggctagaaataatctgaaaactgtgaatccagaatctttgaactggtcaaaggattctgatgtaacttggttatacggtccgattgtagtgggcgatcaaaataactcgacgtcgtcatcaaagcccacttccaacgttgaaataggaaacaatcatgcggccaccatggggtatggttccgatgatgaaaattcaaaaaggttgatccaaaagtctcagagtcccggtcctaaacctattctaaagaagagaactgttagtgaaattatcgaggaaaactccaaatggagattagatatagcaaggcagcacagaaagcaaactagtgacttgcatgctattttggatccgcagtcaagtcagacaacgcatgacgattatgatgctattgccgcgaaggtgaatgcacaatattacaaaaatatccatacaccgcctgatgaatcggtggaatctatttcgcccgttgtgaccgaaacaaactcgtcgatagtaaataccactccaggtccaatctctggctctgtgatagaaaccccatccgcaagatctgatcctcccatattatcatcgattcttacatcatcgatgaagcaaaagcaaaaaagggaaagacatattcatttcaatgaccgtgtcgaacaatgtattgcggttaatcataaccccatagacgctaatcctaatgatgacgaagtcccaatgacaaataccgattaccactctgacgatatgtcggacggtgccagatcttcgcatcagtattctgactttgacgatggatatagaaattcaggggccaacagcgtcgaagattacgccgatgacgaagatgatgaagacgctgacagctacgattatgatgaagatgacgacgaagatgacgaagatgatgggttatttatcagtgcacatactagaaaaaatcgaaccaattcgggggctagtgatggcacagatgttgcaaattctttaagatcactctcactatccaaatttccaaacgcaactattaaaccacttccagccactactctaaactacggatctgacgatgaatattatgatgaagacgaaaatgaatggtattatggtaacgcagtatcacacaatgtgaatactagcagaggatttgactacatgtatgattataattccgtttacacgggggatacatccaactttgtaactgtggacaattcgtgtgatatcctcgatgtaccggatggcattggattagatactccaatacaggacgcgaatgacggatatatggatgatgactcaagagggaaaatatatacataccatcaaagccttccggtacaagatgataacgatgaacatccggacaacgaattcatcgcagattcttcccaacctggtttcagtcatgatgacgaagagcatgacgataacggtgaagaactagagcttactgcaaaagacccactatcattaaggcgaacctcatctatagggaagtctagagcaaattccattcatgattttatcacaccttccaattctgcatctcctgttttaaaacagacacatagcttcatcactggagaacctttatctcaacacaattcgacggtaagaagaccaccattaaaatctccttcatcgggtagctttttatttggatctgattctgattctgagtgatcgctcaagtgctcttaggtatattcggagttcattttttttattgaggttaaacttaaaaataccactctaccagcatatatatttttttttcactacgtaaatagtattaattagaagaacaacaatttttcttggttttatccatctgcgtagatctctcgctcagcgcttaatgcttctattgattaacttgctacggtgttttatttatgttgagagagtgcgcttaattatatactcaaactaccatgttcactttcttttagaagtatcattgaatatgtaaaaactgaaaatcgattaaagttcatattgtaaacagatacatacacctttaagatgcatagcaaagaaaaagctgttccaacagactataaaccagcgagttaactatgccggataggttactgggaagtgagacaccagctctatctctaactcctgatagtaggacgcaattaagtcgatctccactattggtgcccagtcatgcctcagatgatgctagctcgttgaacgatgatctatctgtattatctagaaacagggatcaaataagggacagtatgtctatgaggcgtagtagttttgattccacattcaattctttttctacaacgatgcatacccaaaaacacggtcttgattattcaccgttggttgataattcaatatatgaaattgtgatgaacaccagatttaaaagatggttgcggcacccaaccaccgaggatattccccctgtagttctaagcaagaacgatattaaggataaatgggacaaggatattaatcaatacagagatgacattaaagacgaatatagggtgtatcaatcgacaaataatatatcaaagttgaaccgaatggagcaaatgagatctattgatcatgataaaactgcccttggattgcaaaatacgaaagccaaggcatttgaagaaatacctgaattctattttgataaggagttcaaattagatcaccccaatttctttcgaatgcttctacgagattttgagtttgatgccaatcaactactaaatgatgatgataaagttagaaatgacagctatgaagagcttcaaggaagattggcattctacttagatactgttgagggactccttgtttctgaaatctccaagtctatacaaagcttttttgacgctttggaagacgtcgataagattagagaaaatgcgacagagacaatcaacgagttggattctgctgctgaggcccttgagaggataaatggggataaaatctcaaaaagaattgagatgattaaagatctcataagaaggaaaaatgtggaaaagttacaacaggggatcctacaagtaaaactagcgaaagaaaaatgtgaagaatgtaaagaaatatatcaagaagaaaaactacaagagtgtttgaaattggttaaagcagttgagaacttaataaatggtgacaatgatgatcccactgtcaatgattggacctctcagtggccgtacaaactcacaaacatctcaagtttttctagtttacagggcataatagacatgctaaataatctgaaggttgacatcgggggatcttactcattgagtctggttaccgtactattggaagatttgaggacgtattcgaagtctcaatcgaaaaatgacacgatcatcaaattgcaatctaggaaggataagaacaaacctcatttaaagatcgatgagaccttccgaaagcaaatcaaagaaaatctaatacaattaatcgattgtgatcagttggttccggcagtgaagctatacgaggataaatttatagcagagttgaaatctgttattaaggttaatctaccgcatgagagacaaacacctgaagagtcgaaagatggctctaaaccaactgccgccaatgggtcaaggctatcaaagttgattcaagaacaatcatctcaagagttccaatcaatgcttgtaaatatattcacttctgaaatcgaactattgaagaggttaacgcggcatcagaaaatgctattagacatttcgctaagtgaattaccgacaacggcagagcaatctgataagatgattattgatcttgatattcggaaaagcgttaacgagggtataaggatagtacagcttcgaatggggaaaataatctcagtgagacgggatatcacatgtacattacgtttcgatcatttccttcagttctacgagatatgcatgcttttcatgagagagtgtgaatctataagcggtgaatttctaacgaagtatctttctgacgtattgaacctccaaatcgatacatatttgaaatctttacaaaatttgaacataagggttttgaaacaaaagatcgatgtagagagatggacaccattcatcgtcgagcccgaattgcaaaaggatgtcaatgatattgtatcgtgtattgacattgatccgtcaaattggacacgattcatcgagttgaacaaaccttctccattagacgaaacaaaggatgagaagcaatcctctaccggtcacaaaaaatccgttgtcttaggtgataagacattcgtggcaagcgaggctctaatccttgccatcaaaatgatcaaaactttattggtactcgcctcaaacttcccatcacagtatgcaagacattgcgaacgtcaattgtccgatgtcttgaaattcttcaatacaaaggcaatagaatctatatcatcatcactgacagacagactatctacaaagacagataaaaacttgaatatcatggccgaatcacttgattgtctagcggaaataacgctactactacaagggtatttccaacgtacgctgggatctaagacagataagtacgaaaacatctggaaacaattacaacagtccagtgagaaattgttccaaacaaacaatatcccgcctcctgtttaagacaagtactacccatcgggtaaacagttcactgcgcatgatagaataggtgatatctcagttgtactgaatatttatgcatatatattagcaatatgaatcacgtgatagtgtggactcactatatgcgtctgtgtatgtatcgttaccctgctttccgtataatatgatcgcaatttctaacgagggtcaacgttttccaatgaacatcatgaaaacattgacccaacgaagctttgaaaagttagagattctgatacttttgaattagaatgttttgttttgtttaccctgacaaaacaccaaagtgatagttttacactggtaccttaaggcgtgtgagagtattaatcactgttcaagtacgcgcggcatttctggtctgttgagcgagaggcaagtaaactacggaagagttttattgacctgtattattagtaattgccactttttttctaaggtatcaatcagtcttattgtctgggtattcccatcttaaacacattgttttaggttaagcagagcatttatatccagctcgtgtccatattccattgtgattcaatcgaggtaaccgggtcttgttaaagcttaattgttttcattgatcatgtcgcagaacgatacgaaccatgagtctgttgaggaggctgttttcaagtacgttggagttggcctagagaaatctggggaagacgacgctgtgaacaagcagaagtccgtagattggtttttgaaggaacaagaccaagaccaggaccaagatcaggatccgggcagggaccaggaccaggaggataatgcgaaacatcgtgatgctaacgatgtaagtgcagtcgctgcagctgctgtggcagctgctctttctgtgaagaaaagaggccgtccaagcgagcaaagtagtactgggtctagtggcaagggtagtggttcttcaggtcagaataataagaagtctaagaagaataaaaataagctacatctagctgctgtggatcctgaattagcatcgttagatgataatttggtcgatgggaacgattcggaggagcaatctcatcaccaattggtccataaggcaatcatggacactgataacatcgcttctcaacacccggatttccaacaatatttgaacacggaagacgatcaagaacctaagaaggaaaaaagcgaagagcgttcgtatggtgacctttccaacatagacgatcatgtagatgacgtctcagtatctggtagcatcccttcacaggtaaggctgaagaaaactgcggaagtgttgcctaaagtgctgtcatctgaatctcataacgacgatcaacaagatgatgtatcaaatttgattcaagaagctgctgccaaagcttcccatattatcaatccggcaacccaatcgaatggtaaatctttcgatgagtctgaagaagaagctctagaacaattcatcaaagaataccaaaagatcagaggcctctcgagacgtcaaatttgtgaaagaatttggtccaacgaaagaaggaaagatgacttctggactaatatctgtagggtgttgccttacaggacaagatcttcgatttacaaacacgttcgtcgtaagtatcacatttttgaacaacgtggtaagtggactcctgaggaagatgccgaattagcaagatggtgtgcagagaaggaaggtcagtggtcaaacatcggtaaggttttaggtagaatgccagaagattgtagggatcgttggagaaattatgtcaagtgtggtccaaatagagccgccaataaatggtctgtggaggaagaagaaaaattgaaaaatgttattcatcaaatgttggataacgccagcactgcgtacgaagatggtgaagatgatgaaatgaaagattcatctactaagatagaggattctggagatgctgatatgctggatgttcaggattctgataagaaaccctctatttcgaactctaaaaagaagccagccgcaaaagatattataaactggactgttgtaagtgaacaaatgggaggatcaagatcccgtattcaatgtcgttataaatggaacaaattattgaaaaaggaagccttgaataaaatcaaaaacatctcagatgacgataaattctggttgctaactaaattaagagatatgggtttcacagaggattctcaagtggattgggaagaattatctaccttaatgcctggtagaagatggactggtactgagttgaaattattatacgaaaaagtcaggactacagttcgccaatacaaacgaaaaactattaatgtgatctgtaaagaactcgttggatatccagaagcctcattgccacttgacgatgaaatacgtcaacatcatagcggtgatgatgaagataaggattgatcctgatcaatacctacaaaataacaactaaagagctgtcatattttattatgtccactctttccatttggtttttgtaacatttcatgataccttgtacctcccttcaagaaaatattcaattgtaattttctctaacaaacttcatttttctcagaatataggatgaggggcaggtcaccacgttttcacttacctgcgaatcataaaacttagttggttttatttttattatatttaacaaaggttagtattttttatatataagtctgtattagtatgcgataatataaaacaattatcactcttccataaccaaccaacttcatcaacgagcacattagctcaatggttaatggattgttatagcgctagcatgaattttcattaacccaagttgaactgaaatagaggcgattttagttttttttatctgtccagttactttgattcattaattctggctattttatatcaaaagcacaacgataagaaggaaaggtaaaatatatacagattccttctgccgagagatctaaaaagtcataatcttgatgtatgtaccggatacgtatgaatcactagaaggctctataatacacttaattcgaagtaaataaactgataaagttgaaattgcaaatcatttaagttaacgaacaatttatgcgcaggaaagtgatcgtaacgcttctacgtttagtacagtagtcagagaaaatagtgttcttttgggtatcaaaaaagatgcgaggacatatttcggaaatgatcgtgtaacaagacagggaagctctgaaggcccgttcatttaggagggttcttgggagtattgattagaaagctaactttcccgggtttcttactaccatctatctccagcatttcatttggttcattcctacgtatagtgaatgtactcatttctggaacggtcatagcactatgggctctcttgtgacccatcctataattaggcaggggaggtacttgttcgtaaattgccggaggaatattttgagatccataactaatgggtcgttgatatcgttgagggtaatataaccctgttctattattactcagggatgcatttggagatgcatcgggaggcattggaggtggaggaaagttgtatttcatttgtgatccactcaaactagggagaggacaaaattgttgttgaccgcccggcggtagcattggaggtggaagttgttgccgttgttgttgttgttgttgttgtaatagcggttgttgattaggtttttgtagggatgtcattaactctacaggttgagagagtgtacgagaatgataagtaggaacaaactggggaggaccttgaggcggcgcttgcggcagactctgaggggagaattggctctgttgaatcagaggaggaatttgagattgtacagcttggagtggcggttgagcttgagtttgaggaggtgtcacttgaggccaatttcgcagttgctttggagaagttaattggccatttgcaggcaccagtggaacaacacctatcctttccaagttagattccagctgacctggtgatgattcaactaatgctaaaattacttccgatggtaaatttaacgcagtgattttcgttaaaatcatatctaacttgtttaaattctctgctttcaagcgctccaagtctgtaccaatctctttttttttcaactcaactaattgtagcaataactctctatcaataggtttcggcttttcgccattgctaccataattaattcctaaacttttcattacttcagcgtacaaactatcatcaacgttctgctgaagtatcgattcttcatcttcagtatcatattcattagcatctatccttgaagacatataaggcaaagtactcttcgtatacttcctaagattctataagtccatttagagaacttaagtcgaatcaagctatttaaagtaaccaaaaaagttccaatcaaataccgcgtttgaaacgactacctcgattataacaagggacaaaacctgtatcactgaaaaaggttagagtgtacggcagtttgaaaactagagagcttagattcaaatgaaaaaactagtttccacagcctcttttaccaaaataaaccgtgtcccacttaaatgatatattattctcaaattaatgtacggttaggaaaaaccaaacacaaaataaaatggttaattccgagatctatcaactgaacagaattcttttttaacaataacgctctcacgatggaccagcaacgtgaaatatccctagttgcaaaagatgaacctttgattctctcttcagtaatgtattttcctcaaatttctcaatttgatgggcagtaggttcaaatcctttaacaaaaaaccttattcctaaatatatatcatgaaatttaatttttccttcttccaactgtctatctgggaaatttctgagtaagcgacatataaaggaatgtagatattaagtaaagtagtaatatatccatgtttggtcgcttggaatggtgcgcatcattttgcgatatgaacggcgtacttatttcatcttatgtttttcagaaagcgttgctcgttcactgtttgtatacatgaaatacagaaattttattttagaatgattgatggtacaatccacaatttattgttacataaaatacttgcgggagattaagtatttaaattagatcaagtaaaacggtcagcgatcgacgtttaggagtaaaaaaaaaataggaaacaagacgaaggaagatgataaaaaaacgggtacaccaaaaagaaagaccatgtaagatatccgatatttaatattcttgcgaattcaatccatttttctattctgttggcgtacataagtggttcctgcccagttggaaagttgttcgtttaagaacatgtttaatttcagcttcaaaattccagtgggatgttgatgtttcataagagatgattttaaaggcgtgcttatgatgtaaaaaaaaacagacaagtagtaagataactgaatgttgtgttcacttttgggtcttcgccgggttggaattgagcaactcaattcttctatactcattcagaatgaaatggagagtgtaatgaaacatcggaagatggtgccatgccaaaacgtacgagacgcaatgagggtacattcttataggtcgattgaaaatgcttcgtgctttcatggagatagtactcacaaaaatatgcacacacgcacaacatgacaccattaatgatgttagttccatttcaatttttgacagatacagaggattcagatagcagactagggaagaaaagaaaaacagcaacggtaaataacatcccgccaatgcctctgaaaagagtcattaatcgtataaaacgaaattagcagcaccagaagtcactgaaacggtacaaccatcgctaccaccgttgtaggaaccgttttcgtaaacacattctccgatgacgctaccaccgtcagctgcaacaatcttgacgttgaagttggctgcttcacggttgtttgggtttggaatcaaagacagataagagataccgccagtggcaccagcaccgaagttcaatggagcccagttaccaataccagacccagaagtaccccagacacaaccatcctccttagaaacaccagcattgttaacgtagtattgagccgatgtcttcattccttgccatgtgtagtatgtatcctggtcgacaacggtcaatggtaacttgctaccaccgttgacaatagttgggataaccatgttttcagtacctgggtaatcggttctacagatggagacgacgtcagacaattcgttaacgacgtaggcactgtcaataccccaagtacacaagtacttttcgtcagtgttggaacggtaaagcttaccattcttacatagcaaaccaccgatggagacaccatttgatggttgatcagatgggtattgggtcttggacatacctggttgacaagcgtaagaacagtaagaaccttctttacaagtaccaccggtagaaccgtccgaattttcgataccggaccaaccaccgaatcctaaccaatctaggtagacaacaccttgaccggatgggaattcgtcacaggacatcacaccgtcttcgaattcctcagttggagaggagaaccatgatagatcaccggaactgctggtagaggttgaagtactaccagatgacgaagaactggaagattgggaggaagtggaggattcagaagcttcagtggaagattcagtagaggattgagaagaagaagaagaagaagaagaggaagattcttcttcagaacttgaggttgaaggttccaaagtagtggtttgttgatcctcagtggacgaagtagtagctgcttcttcggtggaagtgacagtagctggagcaatggtttcaccctggccgttgacggtaacggtttggtaaacatactcgacagcaacagctctcttgtgcttgtgatgagcatggacggtagttgagcagtcctcatcacgcttagcatgagcatgaggcaaagcagataccatagctgcgctaataaaagaagcggaagctaaagcagtagtgaatctcatctttaaattaggcttttaaaaattaacaaaggagtgtattgagtttctgtattgaaaggaaaatgattaattgttagtattagagaacgatgtcttttgaggttaggggggatgggatgagtggggaatagacacaattccaatcgaattcgaatctgtgattgatacactggaaaagaacgtacaattgaaggaaacagtgaaagtattctgcttttcctttaataactgaatatcaatgtcgctggtgctttgaaaaaatgagtaggatgaaatgtgttttatatttcaacaccgaaacaattctcgatagaaggaaactagatggttgagtttgtctcgcttataggcctcgaggatccagcctgaaaggtaaatcaaacatacaatttgaacaaatatgactggtaattgaaatcaccactcaattgcaaacgtatatataataaaacccaactccaaacaaaaaccaggaaacaataaacgtaacaaccatgtcgttgttggacatctcaagaattttttttgggaaatctcaattaaccaccttaaaacgaagccattttccagttaatttttcgagcaccacttgtgcgaaatcacacacatcatcgctgtatctggtaacagaaaagggagcggacctcagaagtatcaaacatgccaaagaaatgatgcgggtcgtgtctcgaaaattcacaccgtttgattgtggcactctgttccgctgaattctcacatcgcaccttttcttgcagtacctgtaacttccgaatttggcaagttcgcgaaaatttaaagtttcctcgagcttcgcctgtttcaccatttacggcatgaaaagggaatttaaggttacccgtatttcagatttagaaatgaaaaacgaaaaggcgcaatagtttccgggtaacggaaagagacgtctcttttcgttaccctaccacagtgcacttgatttcggaataaaatctctgagggcttcggccaggtatttctttgttagtcaatgcgagattgatttctctctcaacaaaaaagaaaaactgtatgaggtgaaaaaagcactggcaaagccagttaatcaagctagtaccgcaagcaataaaaatattcagtttcgaatccgaccctctgtgtatctgaaaaatctctatttgattcccatccgcttggataaataaaaaagaaaactctgtagtaaagaattacgacataccttgtaatgtagaacagcgaatgaatagtcaatctcggagaaagcgacttttacttttgctaaaacgagggaaattctgcaagcgtgggtcttgtaagtgacaaatagatagtatctgtacttaaaagtgtaatttcaaaggaacgtataggttatgggaaaaaaaacgggcgcaaagaaatgaatcaagccgtttttaataatagtctaaggaatgtaaagcagttggataataaacaaaatttgttgcccagtcgcagtttgctgtttctaatagcgtgaatgagtgtataggttagttctattggtgtttcttgtggatagtttgagctaaagtaagttatgctcgaaggccaaaaaactaaatcattctgtgaaaatcatatttacatatatatatatatatatataaatcatatcatggatacatgatgtttgcctcctaaaacaatggcagtacatattcaatataaaacaattctgggtaatttctgtaacggaaagaaaaaaaaatacgctcgagctagacttctgtgaaaaatctcggaattacagccatcccgatgacgcgagaagtaatagcagtgcagctcgttctgagaaaagcaagttaacttattatataatcaacagaaatttcagaagctttcttttcgacgtattacccggattcatacttccatcatgtttgttttgtttttgtttttgtttgtactgtgcggggttttaactcaatccaagctctcgctcaacagttatagcgcctgttctaagcaaaaatgtataacatgattctatggtaaacaaacagactgcgcatagtgcagctgaatttacttcctaaaaggaacctgttcccagcatctacaagggttataagagaacagtaaacgaaaaggaaaggattaagggggacgggatacactgttgttgtttcaggaatacctccgtgcgcgtttttttgcttgtttgtcttgctgggttttgaagtatggaagtatgtttaccgtctggatattttcattaaatagtacgtaaagagaatatcatgtacatatatatatatatatatatatatatatatgcataataattgactgtaaatggctccaatcatatgtttcagtcatgtttgatagtattttcaagaagacgttgacgttggcgttggctttgcaattgacgtttattcaaaacggaatacgccggatacagtttgaatttcttgcgtaatccccattctagcaatgcgtatggaatcagtagcattaaccatttcactaccgtggccatcgttccccggtatatatccaccgggtcaatgctgccgttttcgatatcattcaccgtttctcttgcgtaatcagctggtgacatcggttgattcttctctgacatcttcttacgggtttcaacggctttgataccctccgggaagttgaagatactaccttctggtaatgtcttcttatcagcgatgtctgtggctacacctcctgtaatcatgttaatgacacgtacgcccaaaggacctaattctccgtgtaacacccgagcgtattgatgaatcgcagcctttgatgcgctgtacactgctccaaacggaaatggacatatcccagctaatgacccagtgaagacgattgtccccttagcgtttatgattaatggtgcgaattcacgacatgagttgatgggtccataaacgtttactctgaatgtattatcgatgatttcttcgctcacgtctattgcgggcagagagcagctttggccagcgttattatataatagatgtagcttctgatctggtaattcttgctccaacttcaacttcaactgggtgatatcattctgattcgaaacatcaagtttcctagggatgcatctatctccaaactcggctcttaattcctccataggatgtgttcttctggcacatgcgtacacgtaccaccctctcctcaataactcctttgtgacttcataaccaatccctgatgatgcaccagtgaccaaagcatattttgtctcactcatattgatatgtttttgtgctctctatgaattagattatcttttacggtattcgtaagggactatgcttagagtagaatgtcgataagctttggtgacttcacttttgctagtcatcattaatcctgtgttttgaagtttccaatttttatttgatgattttttttttttttgcttgttatagtgtatttcccttttatttccttaaagaaatgtaatatgaatggaattttttatactaatataatattacatatttttataaaaataataataaataaatatcatattacgcttacatatgtaaaatgaaatcaaaactttctaactccgcaaatttgaacaaggaacaagcaaagctagatcaagaactcatatccttcagtgtttctgagatttcttaaaatgatgaaggaagaatgaattatgatgaatgataattttcattgtttgttctattgatgatttgatcattaattgcttcatggaagtctgtttgaaaaatacacattggtatttttatatatatatatatataaatattcttcatgataaattcataaacgtagtagacagtagttaaagaaatatatttgagttttggttcttcgaatgcagaagcgcaaaagaattttttctgaatatgataaagcataacagtaccgtatcaataaaaagttctcatgaagccatagccttccccataaggatgacttttcattttttttgtgtttcgatgagctttttatgaataaaagatagcagccaataatttgaagaggaaagaataaacgcgcagtaactaacctattggccaaagacttccttcaagaaagcttcttcttcggcgttgtgcaatgccttggaacccgcagcaacggaaccacttgggtttctaccagcatatctaataatagcatccttgtatttgtcagtttccttcaaggtagtttgcaatcttggttgagcatatgcccatccacccatgtttaatggttcttcttgacaccaaacgatgtcttccaagtttggataggtgtttaaggcatcacgcaattgagcgtatgggaatggatgtagttgttcaatcttaatgaatgcagtgttcttgtcttggatagtttcacgttttttatgcaaagcagtgtaaacttgacctgacaataaaacaactcgcttaatctcttcctttggtgcaatgctcttacctaattcgacatcttctatgatccattggaagccaccttcggtgaattcgttcaagttggatctagccaatgggtgacgtaacaattgcttagagaagaacaatgccagtggcttacggaattgtctatgttgttgtcttcttaggatgtggaataagttggctggagtggttggataaacaatttggaagttacaatcttgatgttgtctttgcaacttttcttcacttgggaaatatcttggatcttcgttacctagttgcaagaatctctccaatctacctgaagaatgctctggaccttgaccatcgtaaccgtgaggcaaggacaagactaacccggatctttgcttccatttcacttcaccagcggcaatgaattgatcgatgatgacttgagcagtgttggcgaaatcaccgaattgagcttcccaaacaacgaaataatctgggttagtcaaagagtaaccatactcgaaacccatacaaccgtattcagacaacgaagaattacagatggtgaagttagcttgtttttcagacaagtgctttaatggagtgtaagtattctcggatttttggtcgtgaagaacagcatgtctttgtgaaaaggtacctctttcaacatcttcaccagaaactctgacgtgattaccttccaacactaaggaaccgaaagctaatgcttcaccggtagaccagtcaataccttcaccggattcaactgctttacctctgttggttaaaattctcttcaagttcttatgaacttcgaagttctctggccatgaggagatggtcttaccaatgttcttcaaagtatcagcatcaacgacggttggttcgtgggataagatttcagtagctaaagcctttggagacttgaaaccttcccaagcagcagttaaccattctcttgaagttggcttatagtcctttgccttctcatatgcttcctcgaatagaccccaaacccatttcttatgttcatcgatatcttgcttggtgaaggaaccttcagataccaacttttccgtgtaaacgtcaatgacagatttttgcttagaaatcttttggtacattaatggttgtgtgaaggaaggttggtcagtttcattatgaccatgctttctccatccgacgacgtcaataatggcatcagtgtggaaagtagctctccattcagcagccaagttgaaaatgaatgtaagagcttcaacatcgttggcatttacatggaagataggagcatcaatggttttacccaaatcagatgggtatagagttgatctagcgaatcttggatcagtagtgaaaccgatttggttgtttgtgataacgtgaatggtaccaccagtagagtatgctggcaaatgtaggaaacccatggtttcgtaaacgataccttgagcagcgaaagcagcatcaccgtgcaataggacgctgatggccttgtcatacttgccaatatcgttcttagagaactggatggctctagttctacccaaaacaacaggatcagcggcttccaaatgagatgggttagcaaccaaagacaagttaacgtatttaccagaggtagttggtctttggtaattcatacccaaatgatatttcacatcaccggaaccctcgtattcttctggagcaacagaacccttaaattctgagaagatggattcgtttggtttacgcaccacattagacaaaacgtttaatctaccacgatgagccatacccaagacaacatcttcaacacctaattcaacggaacggtcaatcaaggtcttgataccaggaacaacaccttctaaaccttccaaaccgaatctcttatcgttagggaatttagtagataagaaagtttcaaaagaagtagcccaagtcagtctatccaaaatttgtctcttttggtctacggtataattataaggttgtgggatttcaattctttctcttaaccattcacattgttcttttgaagggatatgaatgtattcgataccgtatccagaacagtacaatttttccaaagcagcaataatttctcttagtttcatggtctttctaccatcacgagagaaacgtggcaagataccgggtcccaatgtgatatctctatctagatccttttctgtgaatccatagtgttccaaagtcaactcacgaggtagaggtttactcttatcatcaccaaatgaaatttgtaacggatcaatatgagccttctggtgacctcttacttggtaagcacggcacaaaagttgcacttttaaatgtgttgtgatgtcttggtcaacgccacttaacgaaccccctatcaatatatcttgaggcacaccaggacccgttggtattggaattaatgttggtggggcggtgaaggcagaagaggctggaatattcagattacccatgttcttgaaataagcatcccaagagacatgaactgaagtgggatccttttgccaagcttcgtacatctcatcgatatatgatgcattggtggtggacaggaagttgtccgtcgaagatgcaccactagccaatccacgactgaaaacagccaaggaagtcggtttgcttacagcaccgatcctggtgaatttagaagcatgtaacaaacgctgagatgaccttatagttctcaacattgttcaaaagacagttattttttgttcttttctgtataacgaaagaagcaaaacacaaaccttaaatcaatagatggtcgctttgttctgtacgtgtgttgtaaaattgatatatccagttatcaagtaaaaaaatcccttgcaattcacaaaatgttgaacttttcaacgatgattaactttcaatgaatctttctcgtttatatcttcttttgtttttatttttttatggctcttctttgtgaattttcaatccaaaattactcacaaaaaaagggaacaaaagaagaagtacttgatagtagtagagtcagaaactaagacgacaacaggcaaaaacttcgattcaaaattgactgtttttgttaacgttcctaattaattgaaaaaaagagatatcctacttgcgaacacgaagttgaaataaagcttcttcaatcttttttttcttgtcggaagatcttgaaaaaatacccccgatttttttaatttcccgttctctttcacttaaataagcagtgaaattaatgtataaatcctgtatcttttatactttttagccgataaaaaacagaaataccaacaaaaaaactaaattagagtaagcagaactcaaacagtgccagagagtcgagtattgcgtttactagacgagtttaatttaacaggcaaataataaactccgttattattttccttctgtctcctatcttaattgtattaaggcaggcctcttgaatcttgaaaataataaatacctcttctataaaaatagtaagaaccagtatttatataggaaatagtagatgcactatatatattcacgattttgtgtgaaaaaaaagcactcattcaactattaaatggaccaccaatatctctctcgtgccatttccccggttttgatcctcactcccattttctttctttcttcgaatcggtactgatacctttaatgcctgtagctctctagcagctttatgtggtttttgcataaggtttccttgctacatggtggaacaaacaagtgttttagtgccgcttactcagttttcaacaatacgagaatgccagatagtaaaagctgtagggcatggtctgcgagtaggggtccggtgacccgttttcggattcgaagacgggaaactaccagattcattttgtgggacagcccggaattccgggtaacgtttcaacattttcttttcagtattccatattcagataagtactatgcaactccgtgccagactggctgatgggttttaaagtgtaagcaaaggctgagtgcggttgacggtatgtggtgtacggacattcgtcaacccaactcggtcgcgagaaattctttgctgtcacttgaccattgcttgattatcacttggttcaagatgtttcaatcaatcttcgttcgatacttccaatactactactctcaaggttaagctacactagactacaggtttttgaggctcaactcatcttcggaaattttatagttgaaaactccaggcaattgttatgattaagaaggaaaagaatcagtgatttaacatcaaaaagaattgaggaaacgtaaagtggctctatattgaatcgagctctagcaacgtttccccctatcgtattcttccgatacttgattatcggaagatggcaaagagaaagacaaagtacataatctgaatctatctacttatatagaacatccacctctgaggggagaacgtcttcctcgctagtgtacagtaacgtgtcaaaagtatccgaaattttggttcgcttattcttcttcttcgatcagacccttttcagagacatagataccatccaagaatttacgaatatccttgtttctaacacgacagatttgttggatgtcagcagcgttttgggaaacgttttcaacagagttaccagacaagacgatttcgtccttttggttggtagagaagtcaacagaaacaccttctctgactggaacttctctgaccttcttgtcacccaagaagtttctgatttcgatgaacttagcaccgtccttttcaatgacgttaacgttgattgggaaatgcgcgtaaacgtatctcaacttgtacttgtaacccttggtgacaccagtgatcaagttagaaatcaaagacttaacagttctcaaagcagcaacgtgctttctgtcaccgttgtggacggtgatcttaatttgtctgttagagaccttggtgaaggtaacatcgatgtgcttcaagttcttagtcaagacacctcttggtccagtaaccttgattattctggatctgatttgaacggtaacaccttctgggacatctaggacttggtcagtttgaatgtacttcatttttggttatgtgtcgtttgctttggttggttgagcaaagttatacagtagaattgaacagtaccgtactactgctgtgaaagttgtaagttgaaaaatatggctttccgtattctgattatatatcaccagagtctggacagctttttttcatttgaaaattttttcaaaagggaaatttaatttgcgtcgtaattcaaaacagaagtaaagaaaacagtcccaatatgttgtgtgagacgtgtgggtgttatgaaggtgcatatatttggtgttttacgatattatgtatttgcatgtcgtcagttattgattcaaatactttgagctatatacatatcgtctttaagtactctgtatatatcgtcaggtttttcaaaagaatttattaaaggtaatacgtggaattcactacattttataagcagtctgtttctttcccctattatgtgttcgtttttaacgtaattttacaatcttgccagtagcgtttttgggggttcattactcattcttcgagaaccagtcaatcgcaaattcttccaaggcttctgcgtcattgaagacccaggaaccctcttcattgtaaagcttagcgttattgaacatggtctccaagtccgactttacttcgttgatagattggtattgtttcttgttcaacttctttgttatcgtctctaatgctactggcttctcaataaccttgtagtagtccggatactccttccttgaaggtaatctttcgaaaatgaaagttcttgaatgctcatccgttggatcagttaactctcttagtaaagccaatagtgcctcgactttatcttttaaaggtggttcttctttgcgtttggtgggagcgtcatcttttttcatgttaagcttgagtttgatcttcttttttaaaggtcctgcatcttgttttaccggtttcgcttctttctcttcacccaattccgactcctcttcaggagtagtcgaaggagtagcgacaacctttctcctagaacgagttctaccattttcacgagcaggagttacggcttgctcagcagatattacagtattggatgttgaggaagattcttcaggctcaacgctattttctagactttccaatcctaattgttttctttgacgtttttcacgagcagctctttgacgttcaatggtttcatctaagtcctcatcattatcgacagcttgtaaccattgttcctctgttaaaccatcatcgtaatagactctctttctttctctgattctgccaatagcagcaggctcaacattcaaatggtcagtgatatcttcagtgaatactgaaggtaactcttccttggtgatcaacctcggcagtggctttctcaaacctaaatcgatggcttctctcttctcattagctacacgttcttcatcaatctttttgaacagcactttctcgtcttcagtacgtgcgagaatttcatttaattcttcgtcgtctaattcaccagaatattcatcgtctttgttagtatcaccttccaataatctacgcaaaaattcttcttgttcttcagcagtagatttattgtcaaatttaccggcttgaataactttaccatcaatatccaatttttgcattgctctctctagaataacttcttcgacggaatcggttgttattaatctcaaaatacgaacttcgttcttctgcccaattctgtgagctctatcttgggcttgtaaatcctgatgaggattccaatcagtatcgaaaataatgaccgtatcagcagtctgcaaatttagacctaacccaccagctctggtagaaagtaaaaagcagaagtactcagaatcgggtgcattaaacagttttaacattccagttctatcctctgctttggtaccaccatccaatctcatatatttaaggtctcgcatccttaagaaatcttccatgatatccataacttgagtcatctggaaaaacatcaatactctatgacctgacgctttaaattttggaagaactcggtctagaagttcaaatttaccactaacacgatacaaaatggagctgttctctctcgttgggttgataacattttcaacctcatcgaaaacgaatggatgattacatatcttccttaactgcatgaccttgttgttcaaacctttgataccagccttggttgcaccttctgttcctgcaccaataaagaaagcattatgttttaacatttgttcgtatagttgctgctggagacttgatagcttacatttcacaaccttctcaactttgtcaggtaaatctttttcgacttccttcttcaaacgacgtaacaaaaatggacgtaaaactttgtgcaatcttctaataactagaagcgtttcttcttctgtcatttctagcttttcttgagtacctgtgttcgcgaatggtgtattaaaccattcgtcaaatgtttttgaggaattaaagatcttaggtaaaacaaaatttaatagagcccacaattctggtagattattttgcaatggagtacccgttaaaattagcctattttttgttttgtagtaatgtgtcaacgtgtaagatagttttgattgagcgtttttcattctatgaccttcatcgataatcatatgagcccaatcgtgtttggccaacagtggacgatcctttataatgtactcataagtagttagaaccacgtcgaaatttcccattttgattgtatgttgcaaagccttacgttggtttgggttccctttgtacacaatggttcttagagaaggtgcccatttttcgaattctatagtccagttcgtgatggtggataaagggacaatcaccaaaaatggttgcctctcgttctttatttcataaagataactgatcaacgagatggattgaattgttttacctagacccatttcatctgcgagaataccgttaagatgattattgtatagagacaccatccactctaaaccctttagttgatactctttcaacgtgcctccaaccaatatgcttggctgtttgtctactgtttccttaattctgtgggaaacctcgtaataatcaattttttctctttcttcatccgtgattggaggaatttcttcaccccttttgatgcgtacctcattttgctgcactctaaccgcttgagcaagagaatccaagaaagaattagtttgtttcaatagatgtgtaattcttgtatctttggtttggtctaacaatttcaaatatgcttcttcatcattggacttcaaggctgctaaacgttgcttggcagttctttccattcttctctgctcatctttctccaaatgaccatgcaagtttccgatagatctacccatttgataacagcgatcacgttgtgttgtatcattctccaatctttcgttgatacttgatacaatattattgatcctttgtaaccgtaagtttctttctcttctcctgctttctaccaattcctgcctttcaagttcttctgctaatctagcagtttgtggaacgatggtcttcggtctaacatgaatggatctttgagctgctaaagtataaggagagtcacggagagatggaatgatattatgcgatttagctgcaacactttcaatcagcctctttctcaaagatttctgtttcgttagcattttcaaggacttgagctccaccaaagctcttaacttgaagtcgtctgcgccggtaggaatatcatctttagttacaaaatcaagcgcatcatttaaagaatatgttcccaaattagagggtagattttcaagttgtttaattcttttcgcaatgagtgtggagattattttttcaacctcccaatctccaagcgaggcttcatttccagatttaagacgaaagttgcttaaagcttcgggaaggcctaagcgcacacttgtttcgtcgaaatcaacagaaagtttaaccttctccagttgtaccgagatatcagaactgtcggaacttactgattcatcatcatcatcctctaagaggccatccggtatatttatatctttactcaaaagctgtaagcttaccatttgctccttcaacaacttttcgtcccactgaatatctttggctgcgttttctcttaacctcagcagcctttccttgtactcttcctgtttatccgagatttgggtgaaaatttgttcaatagcctcaacttcaagcttattatgatctctatattgagaaatgtatctgtaacgataaatcaaattttctaattgttctttcgtttcaggtagtggcaagattactctttccaccttcttcatttcttctagaacagcggcaatctggttctgtccaatagcactaccactgtcgttccgaaaattgttgttgcttcctttgtcagcaccaacatggttgtcttcgatattgccgttaacgtcctggttttcagtttcggaattcccattatcaacattctcagaattcactataggaagcggataaggaggcgctgtatccgcgttattcgttacgacgacttgatccattgttgttttatttcacacttcttaacgtgatccaggtctcttcccgctagtgagctttaaaccttttttattctgaaagggggtaaaacaataactgaagtcctgctaaaaaaattcagagttgtcacaaagctaacgcgatacaaacaggtactattgccctagaattctttactgtttcgctttcggtgcgtctatttttttagccgccgttgccgtgttgaaaacaaacctctgttcgtccttttctcgtgtcaaaactaaattcagaataaaatcaaactgttttcaaattcatcctctttttcacaattttatttatcgtgtttacttttttctttgacattcactattgccatgggccaaagtacgggtaacaacaacaagaaccgggtaataaaccaacttcgatcacgtgccaaaatattcgcattaaagtgggcaccattgtttcttttcttgtttaatatttcatgacctaaaatgaaaatttggataatacgccatggatgagatgagatgagattagatgagatgtgatgagagtgaactatcaagttccccgattgagatagttacagtgcttcgaactgttacaaaagtgtcttctgtattgacaatcaaggtttgaagaactaaaattctctgattataatgtcatctcttgcagctgctcatgctaccaacgctgtgaacgcattgttgcaaagcgtactgccgggttctgcgtcggttaatgcagaaagaaagaaaacaagccgagacaaaggctcgaaagcacaactaatagataggaacttgaagaaaagagtagaggtacaagaaaaggatgtataccggatcaaaaagagggagaagaaaatgttgagaaagaagatatctggaagaaaagaagtccaagaggatatagaacagaaggctaagctacaagtactaagaaagcatcaagtagataattctcttacggatcatgagaaatcctatttggataaagtggtgaagaaaaatgttcgcaacctgaaaagttgggattatgacgataaggaagaactgttagatttacagaaacaaatacttgccaactcagaagattcaaagaaggtaaggaaggtaaaatctaggagacaaaagaagaaacagttcaaggagaagctaccacaatcgatacaagaccacagatataaagctctcacacctggattggctccagttggtgcgagcgatgaggaggaatcagaagacgaagatgaagattattgagctcatatttacaaagacgtacaggtacggagttttcattgcggctcatacaaaggtgtgtttttttctctcagcatatgatcaaatactcagtagactcaagtgttcattgtcggttcatatatattaattaagtatattcattatttgaaggaagtagaactactcaaatggtacctgtcctaattccaaatatgcctgttttgtgtctatgcattgtttgcgcactctacgcttcgagtcatctaaaccaatttgaagttttgatataatttcattcttcatggggatcaagtagttaaggggaacactggttgttaaagtctgaagaatttctaatgacagaaatcttacgttcacgttactatatttcgatgggaccaataagttaagtaacagcggaactaacgaatggacatgttcagtaaccaactgagacatttgattcacagtattttttagtgtctctagagatgatattctgacttcgatattctctagttcaagagcctgaagaagaagaggtaacaagtccgtgatatacgatatggtgatatttgatggagtattctttaaaactaaagaaactgcggtaagataattcgatttaatggtcatattatcagaagatttgaaggcgtttaccattttttgtgcaatgtgattgaaaaacttctgcttgtaaattaatcgaatattgttattccatgacacctttttaaatctttgaaaaattagaaggtcaagaactaaaacttcaaagaggtgagcaaccttattgccaaacttctcgtcacttaaaagagaaaatagatgatccgtcaattttgttgcaagaactgaatttttcatgaccaaacctttgttaatccagcatattatttcaagattcttaatagatgtgtcagttaggtccagcacgctttctatgtaagattctgtaacccatttatttgataatagcgccaagaactccaagtaatttagagattcgaaagttgggagagcttcattattcttaatgagttcaatggcttttgaaaatatatcattcgcggcttcaaaagatgtattcttatccaaagctgccaaaagcctggagtaaatcacaatagatctttgagcagaatcaaaaattctttcttcatccaagaaacatttattataggtaataagttcactttgatgggttgagacatcagattttatgttaagctgaaataaaactccagccgcaaggctcaaggagtggtcatcaaggtatatcatatcatttttcaaagagttttgtaaaaatgtctcttccatcgattccttcaagaattgcacaacgttctggtcgaattcatcaatgttattctgcaaaagggaaaaaagacatgacaaaatcaaaaaacaataatcgctgcaatttggatgcattacaatgaggtttaatttcgaagcaagaccaacaatactttctttgaccaaatggtgccttgaagtagtgaaatcgagaatgaccttcaaaactcgctctattgggactatatcagtgttattcaatgtgattggaaccatgttttcattatcaggaagtagatgtaacatgtacttcaaagagacttcataaataatggattcattgaacacactgataaacttgagaccctccaagcatgcgcagtatatattcttattctcgtcagtcaaaattgtttcggtgaaatattggacaatcatcgctatttcctcgctatccaaaaaacctgacattttaactagtgtggtgaattgtatgatagcaagcgtcctcagggtaacttcatttttggatgtaccagttaatgccttgctgaaaaccattaatatgctgtctttgtgattttgtaattcattcttagcatggaatttggaaatctctttaccggtctcgccaaagagtgaaatataagcgctaaaaaatggcgccaaattgagaatcaagagtttctgtttagaagcatctaagtctttatccatgaaaagcactggaatcacttttttcatgactttattaaatgtttgcaagctcactttagaaattgaagcgagcaggtcacaacactgttttaaatccttatcttgttcaaaatttggaacaaactcatcaaatatatgattaaaaaatttatcaaatgcatgttcatctagtgcgatgagtttcgaagataatgaagttataatagagagcgaatccgagtagttactaatatttccttctggtctcgagttttggttttctgtatccattgcagtatcgaggattgaaggttccgggtctgtgccatttaaaatttcaaactttagggcatcccaaattggcagccagtgtttcaaagatgatgttccactgaatgtatccacacatgctttgagggtcagtatagtatcatttttaacagttggtgacgatgctgccaatttatctaagaggttcccaaaagcatcctcctcaaacttttccgtggcagtgatggcacttctcaaggctagtttcaaatcattattggtaattttgtatggatcattacttgggggtttgaacatgattgggaagtagcagaataatatatcaaataattcctccttgaaactgtcaatgttgcgtaaaccggtgctaatatcagaattcaaacggaaagatatgagaagatttctaggatctttctcaccagttgcaacaagaataaaagtttcgatatataagtcattcaatttgagattgcccaacatctgggatttgaatttgataagtatattatccataatcctgaatccgaaatatctagtcgcagccaaaaagttagtaggttgatagtcatttcctaaaagttttaacagcttttcgacgtgactaacgtaaaaacagtccattagtactaatgagttgatcccttgtagtgtttctttcatgcagcctgaatcttccatcttactttggtagaaatcgaatatcactgaaacatcattcttctttagtaccgctggtgaaatgtgttccaatatacaagataaacagctcaatgcattttgtctggtgctatcgtcatcagaggttaagtactctcgtaaaaatattacaattcgtaacaattcaatgctctttcgagttacctcatcagcgatcgtattggccaatttgtctgccacagaagtattaacctttgcattagccataaaactgacaatgtctgctttcaatttatcttctgtatagtctgtcgccattatggtacgatataaatattttacagtgatagggcggtcttcaatgacaagtttatcgaatgctaaagcactaaataactcgttgagttcttactcgttcttgttgactaaggttgggttttattccacattacgattttgatatgtgcaatgcttccgattaggcttaattatttgattacccggaacactccgtatcatgtgaccagatcaagaataacaattcagtgaagttaacagtaggagatgacgatgaaatgatctgcataagggagtggaagaaagaattgctgtctacgcggtaagagatcgttattcataattgatcgtgttcccaaggtttatggaatacgagaatttgggttgaattgtgcttttatcaaaaggcctattgtcacgaaaattcgctttccaattgttttaaatcataataagaaaggtccaatactgccagatatccacaacttacaattggacatgaactctgggtttatgtttcctccagtggggaaagaaaacagggcacatggtaccttactttctgatgatatgggtaatgattttaagtttccaagtgagaatgtgaaccaagtagaggttgaaaagcaacaacagtatccttccacccagattgaccagggggctgtgcaacatagcaatacagattatcctcaacagacactgaatatcatagacattccaccggtagatcctaatggtgtgaccccagaacaattccatatcaatgcattgcaattgaacaagccgggagataacctgtcgaacaaaattacaaacaatataaattacagcatcaacgaggtatctcagcaaccaagacctgatcctgcatctgctaatagtacatcctcattccccgatgaatacgttgccggattaagacagaaatcggcaactgactggaaaagtccgtctgaatacgcattacacattcttttcacaaagttcgtaagatttgccgagatgaagcttaatatatgtttacaatatccgagagagacggaacctccaattatagaaattttaggagaaggcaaggatatagaatttgacaaaattatagaatcgttgggtttcatttccaagaaaaatgcgaaaccggtaatagatgcaatgatgttttggaggaagacaaagtctgaagtagctgctttagcagcggaaaaactggataaaatcatgcaagaatatgagcagtatgtgaagaataatgagcaagttctggcagctagtcgaactcactcaaaatcatctagctcagctagcagcaggttgacacatagaagaaatacctcatcaaagtcctctacaagcctgaattctcattcagatcccaaatttgcatcattagagaaccaggtagagagaacaaaagaaatggctttccaggccgatagaaaatctcttattaccatttatattttgtgtcgtgttttgatcgagattgtcaagcagaatcctatggactttgatgatgagttaagtacgaagcttgaaggtatcgttttcacacaattgaagactaccgatccatcatcactgtcttcaacgctaattaaatcagcaaattggaactcgttcgcggaattattaggctggatgagtgaaaaaaagtttatctctgtcagtgataaatttatagcagatctcgaaaaaatccctcccaaagttccccgtgatcaagagccctctgtgcaccttttaatcctaggaatgcgttatttgaggcttaaaaactatcctctagaaatgtttgaggaaagtgcagggttcatcaaatctatttcgaagttctttgctccgtcccaaaacacttctattcgtttggcttatgctgaagtactaagtcaacttttattgccgttggctggagcaatgacagcagaggctaatcatccaacgtggatagaagcaatgacgtcgatcctagctacctgtaaaaaacttcaaactgacagcaaatgctggacacttgctttcaagttgaccgtggcagtgttgtgtgtctcagatactgaattgttttccaaaaactggttatctttgatcgagaagaacgttaccaaaattaaatctaagtcattagaagatcgtgttgctttctccatgggcctttcaaggttgatatgggtctatcttttcagatgtactgaaaccttaaacaatacagacaaaacgttgacaaaattgttctcgttatttttgagttcaaagaagaaggagaactggatcacgacagatatggatatcataaaccctctatgtgatgttttcgtgactgtgggatacgttcatcctaccttcgtatttgaaaatgttcttctacatttgatgaaatcctcctttaatgggacgaatttagagaatattgcacatgaaaaattgatactagtcatcaatacttatagaggattacttatgactaaagaaaggcctatattccctgatggagaacgcaggttctatgaagttgacttgaataagatatcggtacattcttcggataaaaattgggccaatcatgaggaacttgtgaagtatttgtacaaacttttcatgttacttgattctaatataggatcagaggtgtggtcaccggaaaatgaacaccgtcgccaaccttccacacctttctcaaatatcacaaattttggtttcggaatcaataatgataacagtgcaaattatgcacgaagcctgaatatggcactttttgcaacccttattgaggttttgccctgctgtttgtcagtgtctcaaagcattccattcaaatctacgattgaaattctatccaggaatgctgtccacgcagatcagctgattgcgacaagtgcccaaaatgcattgaaagtattagctgccaaaaagaatccctacaccctaataacttggttcgctaaatactcatttgatttcgatgaaaagacacaatcaaggtatagcttgtattatctttcttccgcagaatacagaacattgcttgcactatacgtcgaattgcttgaatgctggctcgaagattttactaagaacgacatccaacaatcagaatcagatgccgctctcaatggaatgaaactgccccccaaaactttggaagcgaattatcatgaattagagaaaattgaatggaaaaatacccaaactgtcgtggaagatgtcgaaggcaacggtttattctttctctgcagcgccgatgcttctatccgccgattagcaattcaaattcttcaattgacttccaaattcgataaagcgttgatgcaaaaggcaacaacatatgataaaggtcactcaagatcttcttctcgtttggtagcggaaagtggatcaagattgatcgatatgctcccatcttatgatattccaaaactgctagaacctgagaagcaatcgcttagtgtggccgaaaagtctagacttgtcaagttaaccatgaaatctaagacgaacatcttagtcagactttgtgaatctgaatatggggtcgatgcggctctttggcaaagagtatttccaaaactcttaacgtacatatttgaacaatcaccagtaactatggcattatgcaggtccatcgtctgcattcgtttagtgcaactttatgaactaattttatcaataatgagcaactccactgagaagttcaaggatatactgcccgaagctgtagtaaatcaatggaagctttatctaattgtggcttgcagctctcttacttcaacgaatgaccaaaaactacacattccagcggctactggacagcatggccgtaagaaaagtcagcaaattttcaccgttcagcatcaaaaaatcaaatctgctacttctgttttcaaaatggtcttgcctctattaaactgcaacaaaaactttattaaatctgcagtaatcactggtttgagtgcaatgaatatcaacatataccgcgcatacattgaaagtatagatcaatttatgacaagctggaacataaacagctccaacaatgttatgagaatggaaatggtccatattctagtaatattatctccatttttacaagatccactgattaactcagatgactggattttacagaaattgtctcattatctgaaggaaatgaaaagtttccttgagatagatgaagttcaaaaatcttttgagtttcaacctttgcgtcattacttttctggtttcctttccagtttctacttctcgattagaacgaaagttgattgtgataccttctttccattcgaggcgagggcatcttgcttcaatttcttaaaagaatggtgtggatacggccagtatacttcgctatcttctcaacgatatcgatacatggctgcaaattcccaaaaggcatacgaagatgcaacctttgcaacggctttagagtttcaaaaaagcaagctagagaccgttgcacttgaatgcatgatcgtgttgtgctcaggagaggtttctaaaaccatatatgacaccaacggtctcccaatacagatgtcatttgatattgctggtttactttgctggattgattcactcttgcacgctccgaatgacaaaataaaaatactcggagtcagagctttgaagacaattcttgaagctaacacttccaacgttcaacttatgagggatgttctgcatcaaataaagttacaaacatcagataatttgattcatcatgcgtattattcgcttttctgtgaagccatttgcagacaggatacgctacttttaactgaggatgaactggttgcatttggtttgaatggtgttgtaagcaacgataaagcaatgagagagcacgcaatcgatttattaatattcattgaaagtaaactttatgaatcctcatatgcaagaatattcaaagagcggttatcaaatcagtcgaaaactgtatacaaatctaccgctcaagagatatcaaatattttcgccgaattgttgccgcaggaagtgagattgaaagtattttctagaatgtcagagtacttccacttactgcctactgaattaaaacagaatgttctcgttatgtttgtcccgtgggtcaacaagtttaccttaaagtcatccgaggacttggacactttcatggtattaaataatacctttgctttgacaatctattcaaagaacagatatccaatggaagtagaacaattgtggatttcgttaggtaaaggaaactcattccaaaacattcacgttgttttagaatatattatatctacatctatcaactgcaggaacccagagtttgtgaagcatgctagagagattgtgctatttttggctaatgttccgggtggaatgggcgtcatagatacgttattccatagtctagagccgaaacatataatcccaacatcgaaaatacttcgcgaagagccacaaaataatgataaatattccttcattgcagatatctggacaatcttggattatcgtggtaaagatgttgttttctctaaggctcaactatcaatgattttcttggtcaacttattgataattccgaatgaatcagtaaaatctcgtctaccgttattgctccatatatccgtttgtctacttgatcatcacgtacctatcatccaagatagcgcgagtcgtatcttatgtggtattatttatggcctggaacctaccaacaaaaattccgatgaaaccgtcaaccttatcaaaaatcgtcaaatgctctggacgtatgagaacttgacaaaggaatctggtgccagatctcccaaaagcatggacacaatgatacgtaatatcattagcatattttcagaaattgagaccttacaggaggactggcagcgaatctcactcaaatgggccaccacttgttctgttcgtcatattgcctgtcgatcttttcaaatttttaggtccctcttgacattcttagaccaggaaatgctacgagacatgttgcacagattatccaacactatttccgacgagaatccagatatccaagggtttgcaatgcaaattttgatgacattaaatgcaattacagcagaattgaatgctgataagttaattgatttcccgcagctattttggtcggtcgttgcttgccttaatactatacatgaacaagaatttatagaagttttatcttccctttcgaagtttgtttctaagatcgatttagattcaccagacacagttcaatgcttgatttcaacgttcccatcaaattgggagggaaaatttgatggacttcagcagatagttatgatcggattgcgatcatgcaactcatgggagatttcgttgcaatttttagatagattaaatttgctcaacgatagtcaaataatagcgaataaggaatcacgtattttgtacgccttacttgcaaatctgccacggttcctatacgcccttgatacgaatgatatgaacgatggtgttgtacgcggtgctaactgcttgatttctttatgtatggcaaatgatgagccatcgctatcaagaattatagactcaatggtgaagaacaaattcagatcgaagaaggatttcatgagccaaattgttaactttattagttcgaactttttcccaaattatgcccctcaagctttggtattcttattgggtcttcttttcaacagcatggactgggttaagatacaaactatgcaactactaaaacatatctttccattgacggaattatccagaccggagtttataggcgtcggggccgacttcatttcaccattgctaaggctattacttggtgaattggaatccgacgcgttagaggtactcaataccatccctaaggtatcggggagcaagatggataaagatgttctcagaataagtatgggaaataaggacgcgaagaaggtatataacaagacagcgaccttatttggaatccccgaagagagcggctggtctattcccatgcctgcgttgacggcggcatcgactcggcataatgtgcacgctgtatttacaacttgcgcggtaatggtcggtggggaagttgataatggcgattcaggtattctagaagagattgtcgaattccatgctgatggtggttatgtacaaggaacagatgaattcggtgacgtggtatctgtcacagaagacaaagacccttcgttaagccatatgtgggccgaattagacgatcttggctctttcttcaataaatcggattttatggaggaagaacaggaagaagatgatgtctgattaagttttcataatcaagacttggaaacatctaacaggtgtataactaattaaataagacttatattatttaagtttggagatagtaatcgcactaaagctatcgattagaaagcaagccaagtgagactatatagtgtctgttttggtatcatctaatggttcctcctttgtctttgaatcattggcagttacaccagacatatacggtggtaagtatcttccgaataattgcacgtccaattggtcaaacatacctggaacatacgtaccgtcgactgcggagtcaggaatctgattaggagtagttgtcgatatgtattggggtgtctgttgaagagactgtttgttttgatttgaatcaacgggcagatacctatccatattgttttcaacggggtccaatgatgcaccaaagtttgtgcttgagaacaaatttgctgtttgagaagtattcaaggtattcactcctgaaatactagtatttggttcaactgggaacgtgttcgtaaggaaatttggtgttggaatttgtctttcaagagtatctactgatctatctggagatataactgcattttcgttggagtcatcaatgggaagatcaaagaatgtaccgccgaaatctgaagagtcttcgaatttcgtggtagccgcttgttgttcctgttggactttcttttgcatttcaacggattgtttggttttagcattgaaagagttaaataatgcagtcaagagattataagtacgactagctgccatactagtctctttaagctgaagaagaacctgttttccatttcttacatcattcataatttcatcatacgtggcaatatcttgcgaattagtaggagttaattctcttacgtaataaatcaaagcagcgacagagaagaagatcgtataaatactgaaccaataagatccaggcaagattttcgcatccatcatttctttggccaatttaacgaccgttctggccactgagatgcaattttttgctctttgtatggacaaagtatcagtctgaggagccgatggtgaaaggtaatggataaagggacggtatagaataatttggacttgcaaaaatgatagatgtaaaagacagttagctctcaaatacctttctgggacatccttcaaacctggaattagttctggaggaagttgatcgagccattgccttagcttcaattccaaatttgtcaccatttgatgagatatgaggttgttggtcttcttaatgggatataaatcagccatgatttggtcaagaatcattaaaattttggtatgttggtttgctattcctgctgaagacaaaacatcgccttgttcttcagggtagatagcgtcctcagtgatataatcgtcgttcaattccagtggtaactcttgatcgaagtctcttggggatatagtcctaggtagacctaacattgtgttaatgtaaatatccattttgtaaatggtgtagaacaatctcttcctcatttcaatctcaatgaaattcgtttttgtttttgacggatccggttttatttttctatgaagaccttctcttaaagcacttctcatggcaacaccaatataagagtagctcgtggatagtctggcagagcattgcaagaaaaggaataaaagaacaatggtttgaattgaattcaagtctctggcatttgtgatgtcaatcaactttcttgctgcaataaaatatttgtacccttcatcttgcaagaactttgtagaagcatcactactattattattattattattggtgttattattggtattattattggtattattattagtattggaatcaggagtattagtatcagtgttaatatcagcattagtattattattagtattactatcatcatcatcattaatgttattaggggattgttgattgacattcaatctgtttacagttttggtaaagagggtaccaactgccattactgcatagcacaagggcaaaaactgcatttgctcatgggtgtaattctgaggatccgtttcatagagtaaatctaactgtttgataaatgatggtctatggtaaaatctgaacaaaacacagcagttttcccaagtagattttataaattgaatggcaatgggtttcggtggtaaaataatcttaatttctttaccctcatgggattctatcgacccatccacgttttctatcggttgtaaattttgctgtagatgtgaaccaatggaaatagatcccgtacctgaaaatgaatctgacatgtctctatctctcgttacaataggtgcaacctcagtaggtgcaatcaaattgtattcttgaaccatttcattgaggttgatatccttcgtggtattatggaacagctgtgcgaaagtcgggatatcaattgaatcgatatctggtatatccgggatcaactctcgaagaagttcctcatattttgaaaccctgatctggagctgtttattcttgctggccgaatatttcttgtgatgtccctgtgttgaagcagcactactattagacacaccaccgtggttactgaaaccagaacctagccgttttgaatgtgacagagtgccagaatccgatctgtttccaccagtaaacccatctgatgactgtccgatgacacctgatttcttaccagatacagtaacagtcccagcgatagaagaaccaactgaattcgatgaattagacccagtaaccgttcttctggtcggctgattgtaagtacactcgtagttgtaaacggtacagtgaatacaaggctgtttcccatcgcatttgaccttctttttacgacattcgtcgcatgctctagtgactctgcgtcttttattttgaagttccatggcgttgtatatcgacgtctctaaatctatctcacaagtaagaaccagccctattcgtaaccactataattatgcaagtttcctataccctgttataatttcggctggtcaatgtggttttgagattcagtgaaatttcggcacttgctggatactgaaatcgttgaagagtattcacaaaaccttgccttaagtatcaaaatgcctacacctgacaatagattttaattcacgccaagatctcacgttaacatagcgacaagcatatatatatatatatatatatatatacatattctatgtaagttaaacccatatctttaatatatagcgcattttctgttttaaggcgatgcccaatatctcgtgtgctgatattcactgattctcgattgaagaaatttaaaaaaaaaaacaactggaaaccgcatgaattatgtaaacaagaacagcatggaaagaacctccggattcatctccgaaccgtttcgctctctcactaagccttgatagcaaaataaatgtccgatacacattgcagtagcaacaaacggagcaagtcagggaattagactgggcacgtgatacgtattgtgtatcatcattaaatgcctatctaaaataaattactctatcccaaagcgtcgtcgtacatatagtgtcgttaaggacttgtcttctatccgagggaaaaaaagggaacaggaactttcttcggagaaggtagcttccacaattacagttgtagtatcatgtgacgtacttacccggatatacacatcttttgcatctcagatcaaatgtgcagcttttcccctttttcgtgcaacaaattccgtccctcacatcgtacacgatgatcctgaaactacgtcctctagataagtactgtcttatctaagagtatcccataccattctttagtttttcgttttttttttttttattttttttattttgttttgttttgttgtcaatgctttgtttaccaaacaaaattttgaatttttcacatacaataaaattgaatcaacattggattaactctataacaataacaaacaatatctagctttttgaatcagtggttatggaatttcaaggattcagcggttaaagtcagtaaaatcgttgtatattcaagatcaggctatcaaaagatatttgtacagctcggctgttttgatttgagcgtgtgcggttttctttatttttctttttatcagtaaagtaagccttactaatttttattgtctgtttattctggttcaaatcccagcctttgtttggatcctttgtgtttttttccttttagttcatcatgatgtctcagtcgcacgttcagatacaacaaggtaacggcggaagtggcgctggcggtttttactatcgaggcgattctaatgcggttatgaataatgttgtgaatacaggcacgggtattaatgctagtgccggggcaggtggtgtttctttgcaacaacagcaggatttcgttaatgcgcttataagtgtgttggaagtgcccaaggatgccacttctgttgcagctgagtatgctaatgataagaatactgccagtgaagtgcaagcttatgcgaaaatcgcgggcaaagactggacttactatttgaaagatatagtgattaacattgggaggaacacttctccaggcgatgcttcggtggatatagatttaggtccggcaaaagttgtgtcaaggcagcatgctaccattaaattcaattcaaattctgcactatgggaattacatgtcacgggacgtaatggagccaaggtcaatttccatagaattaattcaggccctaattcagtgcctcatccgttatcctcaggatccattttggatatcggtggtacgcaaatgatgtttattctaccagatcaaggactttacattgatccgaatgcggtagcccatttgactccaaagcttttcatggcttattataacgttactacaaatccattgttacgaaaccttttccaatctaatccagatttaattcattcgttggaattatcttcaccctcccgtaatggtcaattaggtgtcagctctcagactcaaatgttgcctcaatcaagccaatctcatttgcatagccatggcaacggtcagccttcagtgagagctttcaaaatgtacgatgctcctgattctgccatgaggtcacaactgctgtcagaatctacgggacagatgtatggttccaacggtgcttctaatggacacggaatgtcacacagtaatggttcctccgacatgtcgaacggtcaactgtatggtaccatcgctaacactggattcaacattgctagcacagatgtctctactgatttatctcgtgatgaaaacagaaatattaaaccacctcatagttatgctaccatgattacacaagctatcttatctacggaggaaggtgaattgtccttatctgacatttacaaacatatcgccaaccattactcttactaccgttatacaaaagctggctggcaaaattcaataagacacaatctttccttgaacaaagcgttcgaaaaggtgccaaggaaaccaggtgaaccaggtaaaggtatgaagtggagaatcagcgaagaaactcagagagatttcctagagaagtggcaaaacgggaaaatagggaaagtgaggcgtggatctagtgtcactagacagttgcaagctcacatgtatcgtttcaacagtctacccatacaaagagagaccttcagcttcaacgatcaaagtaagaccaatgtaaaaccacaatcatcatcatcgtcacattcggattatagtcaaactccgaagctagaaaaatccttgcaatctctacaacctcattcacaatcatcgctacatcaaacttctccacctgtaccacatccaccaattccttcatattcgcaacaggatcatacgtcttcgaactattctacggatcattcacatcagtccgaccttccggctcctaaaagacaacatttgaatccaccttctcaacatagtcaacatcaacaaccagctcttcctccaccttcttctgggcagacaagatcacccaatcaccagcagatgccttccaatgtatcttctaccggatcattgctacattcacctaacaaacatttccaagtgaacgctgttgaagcgtacactccggaaagaggatccaacttacagaaatctccacaaccaatacttaatctaccatcccttccgcaggccactgacatgggacaatcgacatcaaggtctgactcaaacgctttgcagcttccaacaaaatcaagccctggagtaatgaatttattacaattttcttctgtaaataatacaccctctaccaatttgcaacgtactccggtatcccacccacaagtaacggaaaatctggatgggaaagattccaaatctaatatgttggccgtgaataatgcatttcaagagtcgaactccatcaatgaggatgacaagaccaatcttctaagtgccaggaacgtgcaagatgaaaacgatgaagatgaaggcagaataatgagcagtccaatcaaggttaaagataacagaaacaatcaactggttgttgatccaaatgaaaattcggttatagtaaaaaccgatcaatgataccctcatagtgcaattatcatatcattaacagtacaatattcaatgtacccaacctgaaaactaaactcaattcttcccgaacacttacgaaatttacataccgtatcactatcttgcctctccttataagtaacaatgttgttattatgtatttctatttgttatgcttttgttacgtttccatgtcaagatgttcctcatagacttcatgctacttctgtgactttcttaccttcactgcgaaatcttctaacatgaacatcgtaatgaatcattgcgaaaatatcctttttgagtagaatatatatcaaatagtaatgttaactgcgataagcgcgtaagacttgaacaccaatgctaaaacctacacatggttgacgtctagcactgcattcactaatgaagatagacataggagtagacaataaatgcggagattttgtgacgtatatgaaagatgaagctttcaattctcaactacattacatatctgccatcagctcatttcccatatctaaaatgatggaattactgccattatcaggaaacgaaacaatttacgaaagtgttaacgtactgtcttctgtagatttaagtgatttgaatagatgcatccgttcattatatcaaagaatcatattcagccctcttcctaaacaaagcgatgccaataccgatgacagtaacaattccaataacgctaatatgcaaatggaaactggaaagattaagacagacagacattggatatgtatcgagggaatacagaccatgttccagtactctcaactgaaagatccggtggaagcacacgcttcactgaatgatacgatgctccggcttcgtctgttacagaataagtgcccatcgatcgaaatactattcctactccccccgcatgaagccccagaattcatacaatcgctacaggagcatgatatttcaagaaataacatacctcatagacgacaagggaagagattcaagagagacaacacaggtattctcattggagactatatctggaagtactatatctagacagaagaatggcgcagtatatacgacatattcacagtatgatagggtaagattattctgtgtagaacttctggaaacgctttatgattacccggattgaaagtatctgtttcctccttggactgttttcctgaacacccgaacacccgacaagtttatcaaattcacggaaaactatattatttgtatgattaccggatattgcaaaattgttttttcgagaattacagtgaagtcaacaaccaccagaaggagtactgtgcgcgattaggccgcctgcgcaaatcgtttcttcccatgatcgccttcccgccaatcaccccagcctagcttctgactgccttggccagcctactgagaatcccaaactctctttccgctttggacgttactcggctgctcctgactactgtgactctgtctaggcgtaggcaggaatatccaggctgctcacaccgtcagtacgcccagttggtcctgtttcttcctatgccgtcctctggaatcctggtgaacctctaactttgtccatcgcctcattttcagaaagtgttgatagtatgaaattccaagagtgtattgaaaactagtaatcctttgataacatagtgcttatagatacttttataggtttggctcaaaagaacgagaacaaataacgagaaatgtcttctttcgaaccagtcgttgttattgatggtacgtaccgaacgaataagcatatctgatgatatgaatcagcctattgactatttaaattgagtttttgaacaatgaataatgtattgatttgtggatgcgaagaatgatgataagtcagttcataacagtggtacatgcaatgtatatcaatttgaacctgaaattataatatatgaatgcttagaaaggtcaactcgatgattttaggttcgttttagagagtatggagaaacagaaaaattgtaaagaaaacatggcacaacacttgcgaaccgatagcagggaaactaaattgtgatctaataatacatttggcatagcaagtcagcgtgatgatttattaaaaagatgtcaaatttttctatcattcaacaaattaatgcattatgttttaacaaactctgattatcaatggttttgattcataaccatgccttagatgacacttcacattttggataaatgcagaagcgccaccaccggcttgaaataagaaacaattttactaacaattattcacaattccattgtgtttcaaacaggtaagggccatttgttaggtcgtttggcttccactgttgccaagcaattgcttaacggtcaaaagattgttgttgtcagagctgaagctttgaacatttctggtgaattcttcagaaacaagttaaagtaccacgactacttgagaaaggccaccgctttcaacaagaccagaggtccattccatttcagagctccatccagaatcttctacaaggctgttagaggtatgatctcccacaagactgctcgtggtaaggctgctttggaaagattaaaggtcttcgaaggtgtcccaccaccatacgacaagaagaagagagttgttgttccacaagctttgagagtcttgagattgaagccaggtagaaagtacaccaccttgggtaagctatctacttccgttggttggaaatacgaagatgtcgttgccaagttggaagaaaagagaaaggctagatctgctgaatactacttgaagaagaaggcttacaacgccgtcgttgccaacaagtctgctactgttggtactgaagtttccgaaaagttggctgctctaggttactaaactccatcatcaaacaacatataaattttctaaagctcatcaaattgtatatcatttgtaaaacgttattaccatctttacaattttattaatattaattgattgatgtattgaatagttacattacgacaataataaagaagctatatggttcttgagggtatcgccctgggccgcgatttttttctatgcatgattatatatttgtataactgtccttgatctgagtactattctgtaatacaaaccatacatgcactaaccgataataaatagtcttttcatgaaatatgcttaaaatgttcataaactccgaatgttatgcaggtagatggaatggctcgtactaagtttgcaaacaaacccttataaaatcctgcaataccattagtatgccagatagatcgtattagagaattcattttactgttttcattatgttcagttctgaaggtttgtaaattagtctttaataattgcaacggatacacagaactgacagaaatcatttttgaaagtgatattatgcctatggtttctaccgcatttaacctcctttcctgtatatcatttctatcatgtaaatattttagtttcaatgtatcatatattgcaaaatacaatgcaccttgagttacaccaaataaggacggtactaaacctctccaaaatgtttttaacccttcttctgtataaattctagtaatggcatttagtatcgatgtgtatccttgactcgatttggtagacataattctagtcttaataacccacatagggttagtcaacagcgcagttgctaatccactggcgccagcagaaaccagatacatcgatgaggtcattttcctatcgttcatgaatttattttgtaaggctggctcagatgacaaactgtaaacgacatctttggagcaacgatataatccaaaatacagtccccatgcaactgcatttccgataatattgattcctaatccacggtatgcctctttaagtaattgttgagtaccagaaccatctttaatgatacgctgaacttgattgtaatagcttgacggtttgaggtcaatagcagctaactgaagcctcaatttgatcaagtctagtggatgagttacaatagtggttattgttcccgcagtcaatccagaaattatttccttctgcaatggactcaaaactgaattagatgttgcatccatcaggcaaaaactagtatgtacgcagatattgcaatttagccggagtagatgcaacacatatacaatttactcagtcgtaggatgccgaaggtagaaccagcgtctatattttttcaaatggtgacaataatgttcattatattttatggtaaaatattatatgctaaaatccaaatactggaataaacttaatataatgtaatatatttacaagatatacacatacatggatcatagatatacgtgtaaacaggacatattctgtaggagcatggaatcactcagcagcttttttaaacacttggcaaaggagataataggttcaatgggtgtggtctgttagaagtatgagtccagcccaagtatagaataaatggtaaccagccatagtgcgcaacggtttgggttagattcagaattttagtaatacgttccttggattcgtcggatagaataaatgatggtaagaatgccatggtggatctgttttcggtaatgtttgtctcttaacggttaaagttcaacgaggtcaagggaactgagcctgcaattaagatacattacctggtcaaagtgttagcacaaacttgtcttcttttgtaaacattttttttccaactttattcctgtatttcgggcaatgtaaaaacagtcacgtggtctaaaatattaaaagaaccttggggactgctatgagagaataagttcagtagtatatacagtaaatcggagagagtgctgttatgcaaagcgattgcgaggaatggtaaaaacatgagatattcaatttcttacattatatctatagaaatggtaattttttacatagttgcagtatgttaaatcgaattctttccatgcaaggttgtgggtcgaataagtcataactgacctacaacgttgttaaaaggaaagcgtggctattggcatacggtcgaaaaacttcgactaggagaattcgttttggaatgttggtgggtaggcttttttcttctttactttgaaattcttaactttattatttttgatcattagatttgttaggttctgaatctgttcataacaatagttccaatgggttttcaataaccttcttcaattccttcatgaattcaccacccttagcaccatcgatagttctgtgatcgaaagtaccagtgatattcatcttttggtcaaaggtgaagccgaattcggaaccagcatcttcgactgggaccttgttaacggtaccgatagccaagatggtagattgtggtgggttgatgatagaggtgaacatggaaacggcagggttcatacccaagttagagatacagatagtaccaccttggaattcttctggcttcaacttattatccttagcacgcttacctaagtccttgatttccttagaaatggaaacaaggcccttggattcggcgttcttgacgatcggagtcaacaaaccggttggggtagcaacagcgacagagacgtcaacgttcttgaactttctgatgacaccttgttctggcatccagtaagcattagcatctggacatctctgagcagcaacagcaatggccttgatcaagatgtcattgatggacaacttgtattggtctttagcagtagcgttcaaggattgtctcaacttcaaaagcttagaaacactaatttgagaggaaacaatgtatgatggaatattttgagtggattgcaacaaacggtcaccgatgatttgtctcatgttactgattggaacatcttcataagtggcggatgctggagttggggcagctagggctggagcggccttagcagcggaggattcacgagatggagccgaggccaagaaggcttcaacatcatccttagtgattctgcctcttggaccagtaccttcaacttccttcaaggaaacaccatgttccaaagcgatgctcttggccaatggagaagcaaagattctagtacctgaagaagcagaagatccagaggatttcttggcagctggtttagaagctggtttagcaccttccttggattcttccttggattcttcctttgcaggttgcttagcaccattcttggcagcttccttagcagcggtagcagattcggcgtctgcagcagtgaaattagcgaaagctggaacgtcagattcttcctcaacgtaaacagcaagtggcttgttcactgggatatccttggtaccagctggaaccaagatcttagccaaataaccttcttcttggaattcgaaatccatttgagccttatcagtttcaacttcagcaaggacatcaccaggctccaacctgtcaccaacgttcttactccattccgtcaaaccaccttgaaccatggtaggagacaaagctggcataccaatgatggtgtatggtgggtaagaagcatacgttctcaattgaagtctggcagcacaagccaagacgctcattcttggagcaactctagaaagtaatgcagacatttttcctagttcttttcttaatatatgtacacaaacaattgattcgttcccgtaacttggttaatacaattgaatatcaaatgtaagccgattttatcttctggtacagtcaattcctgtgtccaattcgtagtgaaatgtaaccttaataaatattgatatctcagttctaaatgaaggaggaaaaggcttgatgtattatttcaatcttcttctttcaagcgagatcaattaccaacaggtgtaatcagtgttccaatagtatcgtcaaatgcactagcgaatcacaatcatttttttttctcttgtgcaatctaatcgatgttatttacagataaatgttctcccatctaacctttttccttttatttcttgagaatttcagttttcagaattttcgaaatccaaaatatccacactataatggtgcgacgggatagaaggtgggatgaacagaaacatgcccgtgatccgctgcaaactgatagctgctagaagggtttccgtcgtgatagttataaagctttatataatggtatttctcgagatgatatttatctcaatcccaaacctgctcttgagctgtataaatgctttcacaattgatggagtagagtaacttaccgattaatatgtggtgtagggagtttactagtgtcaatttttggctagtgccagcggcctaaacggtggccacaattgtgccaggcaatgcaaatctcgaatgcgggtagcttatttcgtaatctgatgacagcgtcgcgactgtcaatagataaattcataatacgttgtatatatagatagtaggataaatggaaatgagtcagggtttactggtaccaggaatcaagtgtaataggtctgtttttctgttcgggtgcccactgcatttttttcttggtcattgcgtcttcttcccattctatttcgatggtagatttactatttgcgagcatcgtggcacatgtttgccaagagaaccgtaccatgtagggagaccatcccatcaatggtttcatctcgtttcgtagccattgaacggtttttgagtcaccaggataccctgacccaaggatttcatcttcggttttcttgcattgtgaaaggatgatatctctggtcacttttgctaccacactcgcaacacttacaatggggtaaatagaatcagcctttttcgcaacggtgaatttgcactgtgggaagatactttccaatttcttttgatacgagataggcggacccacggtatcgacgtacacgtgacctactttaacaccagatttcaatacatcgtctatcaatgcgattgtcacatcgtgcgcctgttcattcaaattgtaattcttttctggtgggaacctgaacatcccgctgctgatatcacatgcagttatagatgttgtagcgtatccaactccgtctatttctcctccgtagatcatggcaaacagtttctgtctcactggatcggttagtttcttagagtcgtcgaatccatatttgcatattacgtccttttcatattgacgcgtgcaatagctgataccataaaccatggggcccattacaggtcctcttcctgcttcatctactcccaggatgatctcatccgtactttccaatatcgatttgggtacttctgaatggtaggttttcgagtgtaacgaatttaaagatccagcaactgtaggtggaacgctcattccgtattctagcgcttgtgtagagtttgaaagcttcatattagcgtcgatctatcttcagtttatttacatgttcattactatcgtttgtatacatattttaacgttggtttcacgtttttttttttttaacatctttagttttggcgtttccttacaagtcccagtacaatgtatatcaagggaaactgtctagtaattttagagaggacatcgatgatatctcaattttggttatttattgcctgttgacatcgtcaagggtcccaaaacttaaaacttcctcaattcgctgtgtgtctgccaatagcatacacaatctatcaatacccagaccaaatccaccaatgggaggcattccgtacttcatagcctgaacataaggtagatcaaccgccatcatttcgtcatctttgaactgggttttggatgccaattgattagtgaatttctccaattgtaagtcggggcaattttcttcctcgtatgcgttcatatactctttacggttgatgaaaatttcaaaacgttttgtgatttgaacgttattggaatcagttttcgctaatggagataacactgtaggatgatggtatatgatagtcggcagcaaagtatcacactgtgattcaatgtatttaccacatagttcatccaaaatctgttgtggcgatacagacgattctgatatgctgatgttagcttttctcaatttttctttaagaagttcggcattattcaaatccatattgtcaaaatcgattcccgtcttttgtgttaatgtaggtaagaactccagtcttttgaatttaccattgttggccttaatttggtctaataattcttgtgctttgggtttatcgattccctgacatacatatattaagagggattcactcatttctataagttgctccatattgatatagcactgataaaattccaaggttgtgaattccgggttatgtgtagaatctataccttcatttctgaataccttaccgatttcaaagattttgttcatgccaccaatgcataaccgtttcaaccataattcaggagcgatccgtagttcgaacggttgttccttatcgatggcagtacaatgggtaataaaaggcttggcattagctccattagatttagaagagattattggtgtctccacttcaatgaactcctgcttatagagccattctctgattcttttagttaccaagtgccgtatgtatattgcttccgttccattaaccaagtaatccaacgttttattagagtttcttttgctcgaatcaagaagctttggaggaattggtatttgtgctggagagagcattttcaattctgaattcaccttaagggataatgttccctgcttttgagacacccccggaaatcctgttacttgaatgtgatctccaatcttgaactttctcatgtgtgcctgaaactcaccaacagacatgggaaggttactgaggttaacaattacttgcagcgatttctcatcatttaagaggttaatgaaaccaatcttcttaccggagaatctcatattggtgatctttcctcgtaaagtatgtgtagttgaacggtcatctacctttaaaccatcatactctttaatgaaacgagacacatctatcgtaggtttcggaatatttgatagagaagggtaccatttggttaaattcttagatatttctgcatttcttgtcctgtactccaagacaccggcctcggtcgagtgtaacctttggaacccgcgaaggatgtgatatgacctcaacatcggaaaggtatggttattacaacaaaggaacaccacagatggaacgaaagaataatgttagaattgaaccgttaatatctcttctctgatacagcgattgtttgaccgaccgaccgaacaatacgtataccccttccctattatggatttacaactcttctgccgtttctcatgaactagacttttatgatttcgatattttcttgttaaatttgaatactctgacagaaagatatgtacactagagagcaaactagcgaaactaagaactataaacgacaagagtatctacgttgatagaataaattacaattatgtcatagtgcatgtttcgatctcagtagttaaaaaaatctgtatggtttgttttccgatatgctgtacttaaacagccattcaatacgataacgcagtaattaatgctcatcattatcgaaagacaaaacacttgacaaataatactggatatagagggagcgaatactccccacccgaaggagaaacgttcaggttgttgaaaaaatatcaattgagatgaatagttcaagacaatatacactaggcacatttatccataagtgattcatttttgaagtctacataactattcattccaattaatatagcgaagcacctgcttcgcatatctggctattagtggacacgatgagctcactaattcgacatggaggtaggttgcagcctttaaatgatacatttccgaattagttggaaggtagtacttgtactttgaaaatttgtttgtggtttttatagttgttgaaagattttccaatatgctaatgaaataaaacaagaaaatagcatgtgatatagggcaatagtaagggaaatagttgcgaatttgcttcgattggctaaaaaatgttcagcataccaggtaccagtctgattctggaattaagcaacttacatcagcaaatagagtccattgatcacacctatatttcattacatgtgtacgagggttcaaaatatccgggtaaccaaactgacgtcttgtgatctgggctggcaggtcgtttttgatttttttctcttcgcgttctttgacgcgtctctattcaattcataaaataaaaagcacaaccatcattagggccttgacttcattgaaagattcacgttaatcttcactaacatagcaacaccagatatttgagaggttaccaaagaagagaacttcaccagataaaggttatatataacgggcttaattgtttttgcttccaatgttcagacaaaccaagaaacgtgtcgccaatagacgtaattttgtaggcgatgatcagaaccgaattgatgtaacagggtatgggaaccaagatgatggaatgcaatatgatatactataccccaccaaactcacatggtatcgcttgccacctaagggagagataacgttagaacagttcgaaacatgggctatcgacaggttaaaagtattgctcgaattggaatccttatggcaaagaaataaaagtatgaaagaaattgaaaccaccatcaaaccagttttgagctccaaattgaacttgggcaacgataatgaatcaagaaagaaagattactactctcatttcatattaaggttgtgtttctgtagatccaaagagctaagagacaaattcgttagagcagaaacactactattcaagattaggtttcaaatgttaaccacgcaggaccaattgaatttcatcagcagtttggatcttccatacgtaaattctattgatgaagaagagaaacaatctttgtcaacagaattgtatcaaactgtatctcatctgttgactttccaattgaatttgacggaagaaactcagagaagacagttcttcaacagagaaaaatactacaagttacctatggaaaatgtgatggatttagtcgggtcccgtcagatttttattaagaaaggatgggcatacgtgcctcaattccaacagttgaatcttatcagtaacgaatttagtgactgtttgcaaactgaactaatgggcacatatcaaatgattccaaaacttaacgaggatgatagaatcttacctattttgcatcatttatcctcggggtatgttgttaccgaatcacaagagttgaatggtgcgggtgtaaatgatgaattcacacatagatctgtgaagacaaaaaaagttatggaacacttcccattatgtgctaaacaattaatggaacaattacagacaaaccatcatctcaggtatcaaggccgtcaacagctatcgtttttcttgaaaggtatcggtctgtctgtagacgaggcattgcaattctggacggaatcgttcacttctggtggaaagatgactgtagatcagttcaacaaagaatataagtataatttccgtcacaattatggtcttgaaggtaacagaattaattataagccatgggactgccgtacaattctttccaagcctaggcccagtagaggagagtaccatggatgtccttacagagattaccatccggataaattagttgcgacgctgaaagagatgtccttaacgcaacaacaggtcaatagtgtggtagaatcatgccaacaacaagattacaccatcgcttgtaccaaagtattcgaagcagttcacaagactactacggctgatttgcagatagtacatccgaatcaatatttcgaaaggtcgagacaagctgccgccgctgttaccacaacgaattgaattaggattagaaataatcgaactaaatttggaagagatgcgactttccctggaaaaaaaagtgtaacgagtgtaccgaatcgacagaatattcgaaacgttccagagcaaaagcgtgtatgcgttaactgagcggagaagttgctattctaatctttccgatatcattgtcacggttgtgacactgtcgaagagaaaccatgctcatacggggcataacgagaatgcacatcttgaactaagtatatcaactgttgcagttacgtaatgcgagagcatgtacgtttagcagcagtcaatagcgattgaataacaaaaattctcgctatatggaggatgattgaatggccaggcaaaattcagaattattgcaagccatgcgaagcttgtcattccatgtcgtctcaagtgccttatcattttgaaacaaccaagtaggtatgaatatgaaataaattattaggaaaccagtacccaattgatgtcccacatcgatataatcgatacataatcttatatccgtctgatcttcatcctggatcggttataccaagcacgaattcattacgtcagcatacatgctccagtaccacattgtattggcacagacgcaaattacttattctttgcaaaaacgatataaaagcgatgcatgattccgaggagatacacagtacgaaataaacccagggtattaaattcgatattcgcttttgacacgtcgcattccttccaatgtggcactctaacatgtcttaatcctcctctttcttctgggatcttactgccgttctcttttttttttttttttttttgcctgtttggaaaagaaaaagtgaaagctagaatttgattgtcatctttggaaattgccgtttgaaatggaacaatggataagcgtacggggcgtctcaagggcacagtgcctcgcagaggcgcagtattccatacgataggtagcaatgttttctgtattattttagtacatcgtgcatactgataatacaatgcatgctttttttttcttacttttgctgtaataatattttctcataagcagaggctaaaaatgctcaaagcacgtctgcggtatcaattgtcctttgtttcaggtgcaatccaatctaagtcctggtttccgctttctattcgcagataagacgagagatgggttttccatatctggtaaatgtccattttcgtggcggaatttgagtggatgtaaggttaacgcagctgtgcttttttctacattggcccgcagcaacgcagagatggtgcgagagggacacacaacacactcagtatacttatcccatcacttcaatatctactctctgactcccaagactccaaccaaacacttaccagcttgatctttctaatcaagccaaacttgactgagacgtctgataaccacctgtatgtgccttcctgtatacgtatgtatataactctttcatgtgtctcacttgtgccatagacacgactgaaaagaaaaattttaagaagggaaaatccttctcaagagcatgttctagtccttgataggcttgcatcttccctacgcttccattacgttttttcctgcaaaaattcctgtcggtgcacgttatctgagcgaaatctacacgttcaccatcagagccacccaaagaagaatacagtctggccaaaagagcttattaggtagcattcgctccgtacgtaatggatggactttattatgcctctttccggcccgtttgttcgacatccaattgggtaacagactgcgaaatacacacctaaaattactgtcgttttgaactatctattgaacgctccactttgcatgaggttggcatcaaccaccggtattgaacacagaaaaaaaaaacaccttgttttgatggaaatcgtagaattggagcactgtaccattgattagatgtgaatggcaggcgaagcgcctgccattcatgatagtataatggtccgagcccaaactagaaagtgatacggacagctggaaattaactcgttcaattctttttttcctggaagcagggacataaaacgagaaacctgcaaataacatatacacaaacccagtagaaaactctttctaataacttaattaacttaacttaacctgtatatactaacttccccttctatccactggcgaggcattcttccttcccgctcttaaagcaacacgtaataccaatccataagcataatactatcctatctaaagaaggcgcgctacaggaaaagaaaagttttgtgaaaaaaaaaagattctaccacgctatatcactgtggatacgaaaacgtacatatatggtgccgattcacacagagagattgcgtgattgcatgccttgcttgtacatctttttcattcaatgggtatcggtatgcttctgaggaagcaggtcaaagagaaaaagaagaaaagaaagagttatattaatttagaataaatactacggcactgcaaattctgatctgagctgacctgatctgttctgatctgaagggaattgcattaaaaccttgtaatttccagctagaactgctctcttttttttacatcgctgtttgagtttcaatctggtttctctaagctgactgcccctattatataattcccactacagccggtaaaagatagacaagcgcttgtcgaacttccgtacagtaatcaagactctccacagaagaacggaaagaacacacaaaacatctttttatgctaacttgggaacttaacactaccttacgtttgcacaccattatttcattttttttcttgttccgtttattcttcttcttcttcttcttcttcttcttctctgcttgaagttaggaaggaactgaactgaaaaattggataccaagctaaacaaagaaaaaaaaacataattacctaattgttattaaaaagggccagttctctgaccagaaaaaaagataaccagttcgtccatatttaattaagtctggaaatcgaacgtagaggaataggagtaccagaactatacgttagttcactgatatctaggaattctctaggaacagttcaagaagagaccaaaaaatttcttcgaagcaaagcatttgaatccaatccaattacctagtatttgggtaacgtattcattgattttttcttcgcttctggcttttttttctttcttgaatttattcacttctattttatttcatcttattttgaactgcattgcattgcgtgtttttgtttgattcagtaagattttttgttattctgtctcattttaagcaagcgtggtctgctatcatacgtggggttgtactatcagttggtcgatcaagttaacgtcgagataacacccagggattgaaaggcgtacatttggttctgtttgttttttttttgggaaagaaaatagaggtataaacaagattttggattactcagattcgacctttgaattaattcaatctacaaagtggcaaagtttgcagtaaaaagcgttcaatctgatactttattccaattaataagttttgagggtttctgtatttttttttcactcattttcggattagtgaacacatcttcactgagactactatttactccaagttggttatatttctttctacgacctaaaagttcacagtgcaacaaattaagttcgttatcaattctatttggtttcatatctaattcgctgaagttaatcacgccatcttttgcttgtgttttatttgttcgttcatttcgcattgatttttgatataagatgaactattacggctattgggattacccttattatggccaaggacaaggtcaggcccaaggacatgcacaggtgccacctcaggctgcacctatgtcacagatacctgctcaggtgcctcaggtgcctcaggttcctcaagtggctcagcctcagcaggttcaacaggtgggtcaaattccgcaagtgggtcaaatgcctcaagtagcacaggtttctcagctcggtggtcagcctcgtcagcagcagcctaatgaagattctacttcgggaatattgcaacgccttaatccacaaaatcagtatctgggctatgcgcaacagcaaccaattcctcagcttcagcaacaaccacaaccacaaccacaacctcagcaacagcagcaacagcaacagcaacagcagcaacagcaacctcagcaacaggcacaacagtccccacgacaaccacaaccgcaggtgcaacagcagcaacaaccacaacaatatgataaagggttgccacaattgcaacccatgtcaactaatactcaacaaatgatgtattatccatactcaggctattctcactactatccatattcaggatactcttattaccaacaacaggtacctcaacagatgcctcagattgtttcacaagaagaggattcagaactgaaatcacaacagccgcagcagcaacaacttcagcagcaacaaactcaacagcaaccattagctcctcctattatatctagtgctgtaaactcacatcctgctggatatacccaatcgcctagctcccgttattatcagctaccaccaacttccacatatcaataccctcgattccaacaatatggtttgccgatgatacaacaacaaagccaggcttcaatatctacgccgaaatctaccaaccgcaatagctcaggttcttccaccaacatatcacagttcggtaccaatagtccgctggattcatttagtaacgcttcaccaaatccaaaagagttccctttgaaaagacgtaaatcaaataaaaaatcacacttgactccaactcaaccaaacaccactaccttctcacaacagggtcaaaggtctaaagtcacaacaactatgtgggaagacgagaacaccttgtgttaccaagtcgaagctaatggtgtcagtgtagtaagaagagctgacaatgatatgatcaatggtacgaaactattgaacgttactagaatgacaagaggacgcagagacggtattttgaaagctgaaaagataagacatgttgtgaaaattggttccatgcatctaaaaggtgtttggatcccatttgaaagagcattagttatggcgcagagagaaaagattgttgatcttctttatgcattgtttgtcagggacattcaatctatcattcaacaagaatccaacggcaagtatcagcagcagactcagcagcatcaacatcatccgttgatgtcattaccacaacagaaccctgtcccgtatgccaaccaccaggatgattcatccaaccatctcatggttctgactcaggcaggagttgccatgcagcaacagggaaattacaaccctaatccacaaattcctcactctaacatcaacgagtcttctgataataacagccaccaacaacagcaacagcaacaacaacaacaacaacaacaacaattcgctactcaatcgcaagttcaacaacagccacagcaactccaaacagaccaatcgctacgaccagcttctgttgacaataaccaggaaaagctgcaccatccagccggtcaactgacagaagctgaccaaaagcgtaatgactccaccaccagccaattgggagcttcttccaaacagcatgatgaaggaaattctaacacgaatgccaacccaagtaacttgaaggattgattttgtacccaaaatcagatccgttgtaactataatgctttattgactttagtacttctatataacattactacctcttaaatgtaaaagaaatttcacacggtgttattgaaactcgaggcacttgtttcagcaccttttgccatcatctgtactctctcgaacagcagcatgacggaaacgatcacatgtaaagtacatttacatctatcgacataaccttgttgtcacgtgatctcgatattttcattgttccgcttatgtcgatgatttaaaacaaaaacacgacaggtacctatttatcgtgttttgtggatgtgagcgattgatcattgatcatttggacatattgacatttctcacgagcaattaagtataagcgtgtcgtattcgtaacttattagcttctagcagatccagtaaggatgattcacaacggatcaacgcccagaagattcgtatttggaaacaatgacgcgaacgagcgcattgtcccggaagaatataagtacaactcatctatgataaatgaattgataaaacagaataaggatctccacaaacaggttacagaaaaacaagaagaaattgatagattgaacgtgctaattggttcgtttagggcaaaattgatcaaatacacagaactcaacaagaaaatgcagcgagaccaacaggaacagcaacataatcggcatcaatcttttgaatccaaaccaaggtacaaggctgaattcactagtgagtcttcttcacctgttagcaatgaacgagattctgagtacctgcaaatcaagaagaataatcgccatgacgagaataaaatcgatgacatataccaaaaactagagttacttacaaatctggtcaacgatgctatccacaaacaaaataatggggaacagcgagaaccctcaaattttaattctaggatagtaagcgatgatgatattataatatctgaatctcaagagttcaaacagcttcaagatcaaatagacctcttgaaaaggaaactcttgataaaaaaagagaatgaactgcgaaaattatcgttaaataaagaactagccgacttaatggacgagctaagtatgaattcttcaccatccgcaaatcaaaatattgatccatactccgagctgtcaagccgtccgaaatctgggcagcaaaggcgcactaatgaagatcagcaatccctgcattgcgaacattgccatctgaaaagtcatacccaaagtcatccatccgaaccaagatttgtaaatctaaaagaatctctagaaacaccaacaccaacacccactcagactcctagaaagctgaaaagggaaaaggatacaaatgttgcagataaacaatattcgttatggtaaatagtatgtttaattagtcttaggagagttcctctggacttttgtccagattgtattatacttatatatctgaaggtaacattcacgttagaatggtgaacgtcattctggaacattcaaagattcaaattagtctctacaacggttcctacaaggtcattgctgattatttcaattatgatatataatatttttcttgataagtaaatattcttagtttacagaaagttggatccgcaatcctgaagctggggcaccgatcttggatattaaagcaatgcgatcaatctttcccttctcagaaacgtgatagttcgccccagttaaaggatctgctacagatggcgatcctttgtaaattggggtatgtgaagctgcacagatatcaaattcagcataaggatcgaaatcaatctcgatggcatcatatgccatcgaatcagcctttgctttgattttctgagcttggtcagcacgggcacctgatgtaataatcttgaggaattcgcctgcgaaataggatgctaatacaaagttcttgtttttgaatgattgggtcatagcaacattcaaagcattacttctatgcacaggtagaagttttgtcctgctgaagtatgctgccaattccaggttacgcttaacgtcattggcaggtagagcacgacgttctagctccatagaaagacctaagatgtattcacgagcagttgcaagtgcagtttgtgctgttgtttcatcttctttgtcagtaactgctaacaaagctatggcatagataacgtctcggaagtgctcgatagcaacttccaatttgttagccttaaatgctttgaatccctcgttcaacttcgtggtgactacagaaacgccaggaacaaatggtagtattttagatttgtcctcctcatcggcatcagctcggatgtatccaataattgaaggtaattcatttggtgtagcactcatataagttcttgcaccatcgtatatatcaatgaatggtgtcctgaggggttcgaagtttacaacggctacctgcttattcaaggcttgggcagcagcatcaaaggctccagcggctactagaactgctggaagctttgaatttttaacccacattggcaattctgattcatctacttgttcttcagtcacttcggattcttcgatctctaactcgtcgtctaattccaaatcattttggtctaggtcccaagcatcttcttcctctccaacagcttcatcatcaaagtctaggttatcttgttctcctaaatcaaactggccaacattttgggtagtatctgaaacattttcttccttatcatcagaaatttcaagatcttcgatttggcccaaaagggctttttcaaagaatgagacttcagcttgctttaacggccagtttttcaaaggagcagaaatgacaggggtttttacatttgtggaggagttgagttcagttggtagggaaatgtcttgctcatcaatttcttcggattccaaaatggaagtggcaaggtcatcgtcgccgttagcttttgccactgcataagccaaaggagcagagcctgcatttaaaaagacatttgcacgcttctgaactgagttattgtaaaaggtattttgaatcaagccggaaatatctgatctatgttcagcaatagactccatttttgccagtttggagttgtctcccttaagtagatataggaaagacagtttatcaaactgcttagtgttttgatataccaattcagcgatatctgtgttaccttggatcaaagcttctttgcccaatctttcccatacaagttcattgttcaatttctcagcttcttcaagagcaactgtcaaattaccgtattgtgtagccaaatcaaatcttgtttgaggatcctccacgaattgtaacgcaatttcaggatagcctgatttttgaagataagatatgatgttttgaccaactaaatttgaatttttaatgatacgcaatacctcagggaaatttttgttgactaaagtcttcttgaaacgatattcagtaggatcaattgtcaaaatctctacttccccttcacgattcaaagcatagacaaatttgccatgtaccttgttgatgtataatgttctttctaaggttttaatgataccagaatcaccattcaatagacagtatttgatatggttcaatgttgaataaattaggacaccggtttcatcccaacttgcactcttgattctaatactttcatggtttgatgtaacgatttccagttttctgtttgcgattgtcaatgtatgcttactcatcaatgcaacatattggccatcttgagaccacactgtatacttgatgttctttaaagataattcatgaagaattttaccttgttggacgtccatcattaccacagaatgagaatatagaatcaaaacagtaccaggagcagctaatgtgatgtctttaacagtatcagttaatttgattgactttgtggttttgttatctaaactacgaacctccaagctattagtgctgccattgtgcaccacaaatctgttacgagcaacgaagatcgcaaaactaccatcatcagagatgacgttgctagcttcaacagctccactaggttgtttaggtaagacacataagctgaacctgttggcttccttttcggaggagttgacaaggacggaatgttgggatgggttataagacatacttctaaatgaactccaggtcttgccgatgtttttcaaagaaagataaggtagagaagtgattctcttgtggtaatcaaacatttggacttgtttctccctgttgataaagaacaactgattttggtttatagcagttggtggtctttcacggtccaacttaaagatcataataccagaatcatgagcagcaccgaacagatttaggtttgggtgagctctcactaaccagaatctgtcattttctcttttgaactgtttaattggagtacgcttgtccaagtcccatactcttacggttttatcctcaccaactgatataatgagattctgttgaggatggaaaatgacggaatcaacgttgttggtatgacctctacaagtatcgacctcccatgcctttgtggcactcattctccacaatttcacttgacgatcatcagaaccggaaacgatcaatggtaaagttggatggaaagaagcccaatttactcctctagtgtggccttctaaaatgaacttcaccacacaatctccaaatcctccgtcaagtaagttctgttgctgtctcatttgttcttcgaatgattgagtgcctggtgcggaatgtctttttcttagccctgaaatatcccaaactctaacggtttcatccaaagaagcagaaaccaccaaatcttcgactggatggaattgggcacacattacgaagtggttatggccagttaaacatgctatttcctttctgttctgccagttccagattctgatggtttgatcgtcggaactggaaataatccatggcaattcgtgatggaagaatactgtacgaacatagtctaaatggccgtccaatgtgaatagacacttgttgctctctaaagaccatactttgatagtataatcatcacctgcagaaacgaaaagaggttgcgttggatggaaatcaatgccacgtaccggaccctcatgatcttcaaaacggtgaagcaaaacacccatacggtaatcccataattggatggttgatgagaaaagtgctaccagaacccaaggcctagacggatgaaaagcaatacctttcgccctggtagactttgattcgaacttagttaacatcttcatgatgaaagcaagcttttcaagacttcgatctaaatctgagtaaaaactgtgagaaatataagaagaataactcggaagaaaacgtcacaattgcagttaacaatataccaattggttacgattgaagctttccttcgatggttagtcctcactgacaactcaattagacgacaaagtaccttgatcgttgtttattagccaaagtcagcttcattcaaggttcataaaattacttaaaatacacatatggcttactattttgaaataagatcgtgttttatttgaaaagttgtcctttttgaaaattggaagaatccgaagagtatgcaaaggacgtaatggtagggtaataattacccgaatttgtgccagacgcatctctacagattctatgcgtaagagaatgctagaagagatagcatatacgagagtggtatacataggtctatatatctatacatgtatagtgtagatgtgaacatctgggcaacctttactgattaatgtagcatattaagcaatcttttgataggatttctgttattgtgactggaacccccatttgtggtagcatcgcgtgactgcagagcgtttcgtaggagcaaatcttgttcttcatgatttttttccgatggtttattagtgtcttgaataaacctgtttgaaggactctgatccggcccatctccctgctcttgcttcaattgtttacctaccaaaagactttgttgctgtcttcccggatttaggccattcttgtccaaggaagataaataaggtaatttgcccttcttccaaatgactgaatcttcaaaccacgtatgctcattaaacttgtcataattgtaatcgtaagtaatatctaacaatgaattagcatcaataggtaaatgtaatctttctagttcatcaactattgatggccagaatttgttttcgtaaggtgtaacggctattgattccacagttgcataaaattgacccttctcaagtatatcgggcgagttttcccaatcaatgagccctccagcccacattatggtaccagggtcagcatcttctcttccacctggccacaccgacacttgcaatctcattggtgtttgtggatattcgtatctttgtttttcctcattccatgtatcttccttgtataatgttctagctactacaccgtccacaatccagttgattctatcttggtcccaatcgacttcgtaaatatgagtattttcaaaactgtcagaacttagttctagcttttccatccttgtgtgatttaattcaccttggtgataataattagattgagcatgatgtaattctcctccaataaattcaaaatcaatttcatcacctacagttgaaattaataccactgcagtaacaactccgcgacctctagctgttttcatttttacggtagctctaccgtatagaaaagatcttgtggatgatattaaacttcccgaagtatgtttaggcatagcaagagtcaattgaccaggtgcatcgtatttaacaaatccactgtacgtgaaatgatagtctcttaacattttcttaatgattcgttcttgtggtgatattaggaagttagcgaaattaactatacctctattattcaagtccttttctccaccttcattcgatgcaacgtccatactgggttgtactctaggcagaaagctactttttagagcaggtttttgctccagtgagctttgcaaccagaagctaggcgacattcgtggtaataatgctggttgtcctaagcaactacctggatcgtgagataatcttgggttacaacctccaacacaaaaaggacccgtaccgcattgtccaaattgtgagcaacatggccattctgcaggacaattattttcaagagagcagcctattggagtttctgggaaatacctagtagcttcttgtgctaaagttgaaattgtgcaacaggaaatccataacaaaatagtagaaagcattgcgatgctagtaaccaatttctgcgttttttttgtttatgaatacagatacaatttgaggtgtagtagatcaagacaagctgccaatgatagtgtcattgatcacggatgtaaattcttgaacatgatagtcgtgatttttagatccttctccttctgcttttataggttggcttgatttctcataatttgacgtgcgacaatctgttgcgaagaaagtagaaaattgagtgacacaaaacattagattaagatcattcatttagcacaagatgtgatttcttcaaaagagcagctagtctttaacgaaatatttgatttttggagtgtaaactcttttatggcattgctcctttttggcaaggatcatagctcttgaaattatgtgcttatgtatcttatacgttcatagtataatggtaatgtcttgatttagtggaatcaagcaggtctgaatgttggagtattcaagatctatgagcctttaaacaacaagtttcagaatctcttcatcgaattcgatgagtttcttttgttctttgagtttgttttgaactaaaatcaacaagttatataacaactttagtgtaggtgtttcaacaccattagccttagcgattctgattgggttaccaaggataatttcaagttccatgagccttccattttccagatctacacacatggaaggcttataaaggatattcctagtaacatcgttgaagaattctatcaaattctcatcaatggagacgtcctcactggcagcaatggagacaatctcttgcatggcaggtctgaacacctcgaattcggttgcttttttctcgacagagaattcaaagcatctaggaacgtctaaaccgaccaatgcagtagttgtattgatcgctgcgttgtacaacagcttgttccatctggtcttacgaacgttctcatcaaaaacaccagtattgtgaccctcgttatggtatatggagaccagtttcttagcctgtcctatggcaatatcatcatccttatcaaacgacccgaaactaacgtgatctttccccttttgaacgatatgacccggtcctaccttggtggaagcaatcaattgaacacccgataatagacaaagattatacgtcgctgggttgaaatgttccaaaacctctttttcaatatcgataccattctgaatcaaaacaacgttggtaaccttttcgtcatttaatttgtaatttgcttcgataactggtttcaagatagcatgaacggtagaatccttgggcccatcagggatgttcttggtggtgataatgatataatcaaagaacttttcagcagaagatgcgtcctcaacagtcttatagacgttatgaggcctccaattagtgatttcaccgtaatcacaggagtcaatcttgtaaccaaactcaacgacgtggtcataatcggatcttgttaccaacgacacctctgacaacccacaatggtataaagagtatgcggttataacccctacaccaccagctccgatgattaaagcgcttgacgtttgttctgaaggtgggattatgtttgaggacatatttgattcaattgccttattcccaatttcaaacctttatagaatcattgagactcctcttgaaagtgttggtggtttgttcaagttgcagccatttatcattctttttttgcagaagtgatagcgaatcatttgaatttttataaagagaagtaatctcaagccggacttccatatcattagagaagtgcaaacgtaatagagaagaacaacataaaggccgttctggacaatacactgtaaagcatagtgtcgaacgcgtatatctaactttatacacaaagcataaattcgaatggacggtgtgtcacgtgactgtgttgcttcccactttgaaagtgtcaaaggtttttgattctactactatctcttcttctagtgttaaatacgccacgcagtcttgttaaccgacccactaatcaatcaacactttacatcttgtatcttgataaaccttagagtcatagccaactggaatatcgcactgaagttcgtttctgcttgtaaaccttctcgaaatttgctcgacacagagagaattcatcgggcaaaaaaaaaaaaaaaagtttcaacggtactgtcagtgaatgagatggttcaaaagtgctcaggtgctcaattgttatttgtaggtttattcatgtctactttcaagccgcttcgaagttctcatttcgcttacctacccaagaaatttttaatttcaaagtttacttttatctatttctcttattgatagagatgagctaattaatagagcatattaagctcaactcttgaagagttctactccacaggactactcacgtaactagcatatatcggtcgaatcacgaaacagtagggcttcggggtttcaactcatctgggtgtatatatatatatacgctggtgattgcctgaagatcgtaacataaatgctgcaaagtggaaccgttccgttatagaagatagccagtctctatagtttcaggaacaagatacacttatagaaaagacgaactaacaatgagattatctggtttgctaatatggattttagcatggtttcaggttcatgtacaggcattggttttgattgattcgacgctagcgtccgcttgtgtttattatgaattgcaatacgattggggttgtaactcgcatagtaatggtatgaaggcatacgcatgcagatgtggtaatgctgcttggttaggatcagtcacaaactgtgtatatgagaatacaaatagtacgaggttgagaaaccatgcattgaggcacatctcgacacgttgcttgcaaaaaggtgggttcgagtattctttggccgacatgcaaggtttctacaagaatgctacatcatatttgagagagccaactaagatggatttgacaatgccagttgatttgccattgcgggtgaacgaaagttcatacgcatattatcataaagggttcaaagacttcactttctctgtacaaagatcgcaatggtttggctggggtttggttttctattgggccacgatcctcgtgttggcatcaatcttcaatttatctaagagagtgtttgggttcacatgggaaactaactggattagaagaactcttacgttaccatcaacctttggtaaataccataatagcccttacacactatggaaatgcttccagttctatttcccaactagactgcaatcctgggttattgctgtcttcctaatccaaactatcgtgtcttgttgtgtgggttacaacacgatatcaatgcctcatccttatttgacttcgagatggtacgctaatttggatttgatttcatatagaaccgatttaatggctatttccttattcccaatcgtctatttctttggaatccgtaacaacccattcacttgggtcactggtatttcgtttgctacatttaacttgtatcacaagtggactgcatacgtgatggtaattttggccttcattcattccatcatttggactgtctgggctaagtctaaggaaggtggtggttaccttgcttggtggccagatgcttactggcagtggggtgtcttcgccactatgttgtctttcttcatggttgctcacagtcataaatggattagagacttagcttatgagtttttccttattttccataagttattcaacgtcatgttcattgtttgcatgtactaccacttgaataccttaggttggttgggctgggtttggtccatggtcggtatctggggttttgatagagtaatgcgtttcgctaaaattattctatgtggtggcttacaaactgctaccgtcactgattgtggaaatggtgttatcagaatgaagatcaagaaccctcgactccttaaattttaccctggctcctacgcttatgtgtacttcttctctactagtgacccatggatttactcgttccaatctcatcctttcactgtgctgtcagtgccagatgaagatgagtccaccttaacaattatcttcaaagctaaaaagggtataactagaaatgtcttgaaccgattattgaaatctggcgttgatgaacttaaatacaagatctttgttgagggaccatatggtgctgcttatccatgccacaagaattccacccgtaaatttattggtttggccgcaggtctaggtatcagtgctgtcttccctcatatcaaatccgtcattgaacaaacgtcaaccaatattgttcatgaacttaaatggatttccaatgatatgaactgtttgaactggttcagcaaagaattggcgtggttagcatctaataattgcaaaattaccttcatctataccaaggatatcggctctgatacggaatccgtatccgactactcagaaaagccaaaatccatacaagaccaaaagatttcgtctaaaattgaagtactgacattcagtactcgtccggatatgaaccaaatcgtgcatgaagccatttctagtagcgaagaggacatttcttttgtatcatgtggcccttcttccttcattgatgtcgttagatacagcgtcaaaaaagaattagccaacactaaggtagacgtcgatttagaagaggagtcctttacttggtaatactaccaaagaaagatgagatagcggccagcaaggccgcatgaaatagcatgaagcagaacattgagtaatttatatcccagcgtttatttattccacaaacctattttttaatagttaatcatatcagtactgtcaatattatttacatttaattatagccttaactatataatcaattctcattataaagatactcgcatatagcttgaaagccattagagaacatgtgttagagtgtgcttttattagattcaagggtacggcataactacagacggtatcagttatcgtgcaaattttgaaggtaatttatccacgacatatcgaacttttttcgaacataaataggtaaaattgtagataattatttatagtgggtgtgccatgcagtttggtgaatggcaggtatcctacgggttactcattggtatttctatggacaaagatgagcgaattatcattggccagagttaatgcatggatgctgatgaataaagaacgtattattattcccttaattgctatcactatcgctctccgcttcttgcatcttaaggatctctttccatttatatgttagttctctcattgactcgggatctaaactagcttgaactacatctttgggtacttggttctctgaatgctctttggtgacgaatctacccatattgtgttctgtgatgagtctaatttcaggactggcatcggaatctaaatctttcgaagccaactcgttccaggagaaaagtaacgggtctgtagttcttgaccaaggatttatatctatcagccaacatgattcaaagggtctgggtaaatatacatccaacacaaaagactttaggtcgaaattgggtagcacgatatcataaacgaattcctcgataaggttcgtgaatgtatcctgtaaaggttccaaataattataataattcaaatccctttgtgatattccccaaatttcagaatctctgacgaacaccctaaattccagcgcagggtttatgtcaaaccatttccttaatactagttcaaactggatagactgattgtccgaattgtccctatcctcacattcatcaaacgcatgatccaaatcgtatgcgatatagttagacgcatttagtaaaagataaatgtcattcacattcatacatttggaagtattattgggcaaaatccaagtagcatctcttggagcagaccagttgagtttcggcgtgactgcgccatactcaccaatcacttcagcaatctctctatgaagatcggggaaattaaccataggaaccatctcttcttctttcccatttttatcatcgtctgagtcagaatcattatcaccatcgtcgtctgcctcccaatcactgtactcgttatcatcgtcacgctttaagcaatgatcattatacgtagagtcattctcttccaaagaaagccttatcccgtcctgagccaaatatcgtagaaattcctcgggcagcggttgaataatcttagcctttggtgtatattttttgaacttatcgtaccatgatgagaaactacatgccctaatgtcatctgacctcaccttaatatcaactaaaggtgtatagctttcagctgccatgtcaaagaagaggaaacaaaccgtttaatgctgctatatatcaactacctcttcctaaacatacaaagtcggataaagcagctgcacttttgctattcgagcttgcgatgagatgtcaatgagatgatcttgacctttcacatcaaactaactaagagaaaaggttgatcagattctgaatatcacgtgacttgggattttgtcttgtcaatgtgtcatattgcacgaaatatcaacctctagtggcaaaaaaaattgttctatggccctttctttactatgggagaagaagtgaatctcagtagtattgacgaaagatcgaaaagtactgaaaatgacattttattttgattttagttactaggaatggttttgattatggtgaaataaatgatgatgggtttgattttgaagcaaagaaacacacataggcctcattgtttagtttgtattataactgcaagtgactttactcaattctttagcggaaagttctaatttgttttggcaaagaactacggataagtttatcgtttggtatttttccccaatcgtaaagagagtttgaaaagatggtttcacaagctaaacaaccttccaatgcgacctttaagaatcgtgagaagccacaagaagttcgtaaggccaatattatagctgcccgtgctgtggccgatgcaattcgtacttctttgggtcctaagggtatggataagatgatcaagacatctagaggtgatattattatttccaacgatgggcataccattttgaaacaaatggctatcttgcatccagtggctaagatgttggttgaagtttctggtgcacaggatgttgaggctggtgatggtactacctcggttgttatcatgacaggtgcactattaggtgcagctgaaaagttgttgaataaagggatccatccaactattattgcggaatctttccaaagagctgctgaaagatcggttgagattttgttgaacatgtcaacgaagatctcgttggacgataaagaggctttagttcgtgccgcatctacctcgctaagttctaaaattgtgtcacaacattcttcatttttggccccattggccgtagactgtgtgttgagcattgcctctcatgattcgactaacgttgatttgaacgatattcgtttgatcaagaaggttggtggtaccattgatgatactgagatggtaaatggtgttgtcttgacacaaaatgcggtaaaaactgccggtggaccaactagaattgaaaaggcaaggatcggattaatccaattccaaatttctcctccaaagccagatactgaaaataacattgtggttaacgattatagacaaatggataagattttgaaagaggaaagagcttacttgttgaacatatgtaaaaagatcaagaaggccaaatgtaacgtgttgttaatccagaagtctatcctaagagatgctgtaaatgaccttgcattgcatttcctctcaaaattgggaataatggtggtcagagatattgaaagagatgaagttgaattcttatcaaagagtttgggttgtaaaccaatctctgacgttgaactattcaccgaagacagattaggctctgcagacgtagtagaagaagtggaaagtgatggttccaatattgttaccatcactggtgtaaagacaaccaacaagaacccaacagtgtcagtcgtcattcgcggtgctaacaacatggtcttggatgaaactgaacgttctctacatgatgctttatgtgtcatccgttgtttggttaaagaaagagccttgattgcaggtggtggtgccccagaaattgaagtttcataccgtctaatgaaggaagcgcgtaccatggaaggtgtggaagcatttgtttggcaagagtatgcagaagcactagaagtcattccaacgacattagccgagaatgcaggtttgaatagtttgaatgttgtcacggagttacgtttgagacacgaaaatggtgaatccaattctggtatttcggtaagacgttctggtacctcaaatacttacgaagaccatattctacaacctgttctagtatccacaagtgcaatcaggttggcttctgaatgtgttaagtctattctacgtattgatgatatcactttcagtcgttaataggccaatgtagtttcttctcctaaatagatttgtacattaaaaacgaaactgataatatagtttagaataatattctactcctttagaaatattaatactaaccagctatatacaagattacgattggcgttacgagcacgagatggatttgcctttgaagcaaagttgttctttctaaatgcagacgcaaagggcgaagatgtatcgaccaaaattatgcaatttatgagtatggatggcgagatggtaaaaataactcacttcaatttactcagataacggacagcatttttattgaacacgtaggatgctccactccatactgtcgttacactgaccaaatagcccagtaaagtaaacgcaaattgactattttccttcaacaaaccttctttgccttcctcctcatctttagtgttatttatgatcaagaggacaacaccaaatcctacatagatcatttgtacgaaagtgttccacttcgaaatttgcgttggtttaacctctgcgcttggataatggaaaatatcccaatacgagttccatgtaacagagccgtaacgatgcttcattgatgcatacctgaaataaatggcactcaaccccaacaatagatctcttccgaaaataagtccagcaaccgctaacggaatgatttgggggccagaaggtacgcacaaagcggctgtcgttgtcatcattaatatcttatctgccattggatcaagaactgttccagctacagatttcatcttgtacgatctcgcaaggtacccatctaaaaagtcagtgacacaagagtacacgaataaagacattgcgggggcaaggttctgagttaagatgtagtaaccaatcaagggcgttgtcgctattctactcatcgttaacacgtttggtaaagtccatattccattagttatcgcgctttttgtccgttgctgttgctgctgtttcttctctggttcctttaccaaatcacgattgtcagttgagtagaagcgctgggagtgacggaaaggccgtattccaataatttgtttcagagccttgcttcggctaaactgcaagtttgagcttattccgttggttttctgtacgattcttctcaatccattcacttgcttcgaaatggttaaaacgttcaaaatcattgtacccaaaatgacggactttcttaacgttgaacaaccagggaaataggtgatataatgctgctggttataccttccaggttctgatcactcaatagtttcagtgaagtcgctgacttcctggctatttaatctgtccaaccttatgcttccggtgtacctcatcttgctaaaaccgaagcttccatactttttttttttagtgcagagttttgttagttttctatggagaatagaataggtaacgagacgagactaagcccggactatgttgttatgcaattctgaattacgatcccttataatgactctgttgttcttataatgttatattgcagggtatgttatctgttgtctactaaagggttgtatcaaatgcctgcgttcaatcccttatagtatcttgaatcatatcgacatgactaagtgcccaattttccatatttcaacatttcggcatttcaacattttaaccagactttgattgagcagctttgatttacaaacagaataacaagtaggttctatattgtgtgattgactcttatgttattgtatcaagatccaacaacacccgggatttcaattgttaggaagggaaacatataaatagtgcttacctctatcaaaagtgttgtgttataagggaactatttctttattggtatcatttccaggttgattcgtaattggacaagccggtttacatcaggagctctaagaaggtattctgctgctgcaacttcgtcttcatctgcaatgaacgttttagtttataatggtgcaggtacatcacctgagtccgtgaagaatacaattgagaccctacgattattgttggagccatattacgctgtttctccagttactgcaagagtgttagaaaccgaaccttggactacgaagacttccgtggtggtatttccaggaggtgcggatttaccgtatgttagagattgtaagaaagtgattcccaagatcagagatttcgtctccaaagacggtggtttatacatcggaatatgtgccggtggctactttgggtcaggacgttgtgaattcgcaaaaggtgatccttgttatgaagtcactggtccaagggatttgaagttgttccccggtattgcaagggggcctgctttcagtggattcaagtataacaaagaagatggtgccaagactgtcaagttaaaagtaaatggaattgaaaatctccaagaagcttactcctactataacggtggtgcgcttttcgttgacgccgaaaaatatccaaacgtcgaagtactagcagagtatgaagactccgttgacgttcccttctccgatgatccaaatgctgcgaatcaagatgctactgctgctgctgctgctatagtgttatcaagctttggaaagggtaaagcattatttatcggtccacatccagaaatatctgctaagaatctaaagccaattggagaagaatggtatgataataaagtcatcaaacttctggaagaacatgatacatctagatttcaattgatgaaagaagtgttgagaaaagctggattgaaatgtaatagtactgagtctaaccccggaaatccagacttgacccctatatttgttgctaccaaggacaatatggcagaccttcgtgaattcgaggaaaatttacgttcaaattcagctaaaacggatgattctggagatgcataccatttgaccggcgaaaatgatagctttgatatctatgaaggattttctcatgcggaagaagcaagtttaaagcttcaagatgtacaccctgttgatgctgttaaacaaatcatatttcctgcgaatgaggaaactgttcctggtaaaccactgatctctcattttgatatgcaaaaattctttgctcatttgaatccctcgagtaaattgggttccattcttctatatggggatgttgttacttccacaagtatgattttggaccagaataaaacattattggcagcattacctgaaaatagggctattcatgtgggtacaattcaattattaggtagaggacgtggtggaaatacgtgggttaacccaaggggagttcttgcgtcaacaactgcaattaatttacctgctgtatcaccaagttctggagaaagaactccgatcgttttcgtgcaatatctagctatgttagcttactgtaaagccatccgcacatttgctcctggctatgaagatttaccagtgaagatcaaatggcctaacgatctctatgcaatgaaacctcaatattactataacaataacatgaaacttttggggaaagaattccccaatggattaattccgcttgacgacgtcgacccggcatttgtaaaggtatctggtcttttggtaaccacaaatttcgtatcaggaaaatactccttattattgggatgtggggttaacgtaacgaacgaagctccaacgacttccttggcgacatgggtcaaaatcttgaataatgaaagagatgctttaggaatgccgcacttaccgccaattgatcatgaaatacttctagcgaagtatctcaacgaacttgatactttgttgaaaaaattcttgatgtacggaccatctccaatcttgcccgagtactataaatactggatgcattccgaccaaattgtacaactattggaccataactctgtcagagcaaaacttgttggaatcaccgaagattacggcttattgattgccaaggagttgattgctggaagtaatactcatttcaccggaaatgtttatcatctgcaaccagatggcaatacgtttgacattttcaaaggcttgatatctaaaaaagcctgaaagccatatatattacttatttagccttatagtaccctacagttacagtcaatataatgtggattgtgcattaaattacgaaccttaaaaaaggtagatataaaactatactaaaatacaaggtctgaagatgttcgtctctaaagctttatcgtgaaattttaaattccagaatagaatgaagttcattaatatgttaatgataatctgctgcaattcgcagaaaacataattattctcctgctcacttattttctttcttctcttcgtctgattcttgttgcttaggttcagctggagaataagaaccaggactgtattgtggtgaggttggtgagtaagatggagaagtaggggaataggatggtgaggtgggggaataggatggcgatgttggagaataggaaggtgaagtgggagaatatgatggcgatgtaggagaatatgaaggagaggttggagagtaggagggtgaag
